US009062322B2

(12) United States Patent
Hatzfeld

(10) Patent No.: US 9,062,322 B2
(45) Date of Patent: Jun. 23, 2015

(54) PLANTS HAVING ENHANCED YIELD-RELATED TRAITS AND A METHOD FOR MAKING THE SAME

(75) Inventor: Yves Hatzfeld, Lille (FR)

(73) Assignee: BASF Plant Science GmbH, Ludwigshafen (DE)

( * ) Notice: Subject to any disclaimer, the term of this patent is extended or adjusted under 35 U.S.C. 154(b) by 622 days.

(21) Appl. No.: 13/120,460

(22) PCT Filed: Sep. 21, 2009

(86) PCT No.: PCT/EP2009/062174

§ 371 (c)(1), (2), (4) Date: Mar. 23, 2011

(87) PCT Pub. No.: WO2010/034681

PCT Pub. Date: Apr. 1, 2010

(65) Prior Publication Data

US 2011/0271404 A1 Nov. 3, 2011

Related U.S. Application Data

(60) Provisional application No. 61/099,629, filed on Sep. 24, 2008, provisional application No. 61/103,301, filed on Oct. 7, 2008, provisional application No. 61/107,680, filed on Oct. 23, 2008, provisional application No. 61/107,695, filed on Oct. 23, 2008, provisional application No. 61/180,953, filed on May 26, 2009.

(30) Foreign Application Priority Data

| | | |
|---|---|---|
| Sep. 24, 2008 | (EP) | 08165001 |
| Oct. 7, 2008 | (EP) | 08166008 |
| Oct. 23, 2008 | (EP) | 08167387 |
| Oct. 23, 2008 | (EP) | 08167390 |
| Apr. 29, 2009 | (EP) | 09100261 |

(51) Int. Cl.
*C12N 15/87* (2006.01)
*C12N 9/10* (2006.01)
(Continued)

(52) U.S. Cl.
CPC .......... *C12N 15/8261* (2013.01); *C07K 14/405* (2013.01); *C12N 15/8243* (2013.01);
(Continued)

(58) Field of Classification Search
None
See application file for complete search history.

(56) References Cited

U.S. PATENT DOCUMENTS

| | | | | |
|---|---|---|---|---|
| 2002/0069430 A1* | 6/2002 | Kisaka et al. | ................ | 800/290 |
| 2004/0172684 A1 | 9/2004 | Kovalic et al. | | |

(Continued)

FOREIGN PATENT DOCUMENTS

| | | |
|---|---|---|
| EP | 1 591 522 A2 | 11/2005 |
| WO | WO-03/014327 A2 | 2/2003 |

(Continued)

OTHER PUBLICATIONS

Schultz and Coruzzi 1995 The Plant Journal 7:1 p. 61-75.*

(Continued)

*Primary Examiner* — David T Fox
*Assistant Examiner* — Matthew Keogh
(74) *Attorney, Agent, or Firm* — Drinker Biddle & Reath LLP

(57) ABSTRACT

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding an ASPAT (Asparatate AminoTransferase) polypeptide. The present invention also concerns plants having modulated expression of a nucleic acid encoding an ASPAT polypeptide, which plants have enhanced yield-related traits relative to control plants. The invention also provides hitherto unknown ASPAT-encoding nucleic acids and constructs comprising the same, useful in performing the methods of the invention. Furthermore, the present invention relates generally to the field of molecular biology and concerns a method for increasing various plant yield-related traits by increasing expression in a plant of a nucleic acid sequence encoding a MYB91 like transcription factor (MYB91) polypeptide. The present invention also concerns plants having increased expression of a nucleic acid sequence encoding an MYB91 polypeptide, which plants have increased yield-related traits relative to control plants. The invention additionally relates to nucleic acid sequences, nucleic acid constructs, vectors and plants containing said nucleic acid sequences. Even furthermore, the present invention relates generally to the field of molecular biology and concerns a method for improving various plant growth characteristics by modulating expression in a plant of a nucleic acid encoding a GASA (Gibberellic Acid-Stimulated *Arabidopsis*). The present invention also concerns plants having modulated expression of a nucleic acid encoding a GASA, which plants have improved growth characteristics relative to corresponding wild type plants or other control plants. The invention also provides constructs useful in the methods of the invention. Yet furthermore, the present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding an AUX/IAA (auxin/indoleacetic acid) polypeptide. The present invention also concerns plants having modulated expression of a nucleic acid encoding IAA polypeptide, which plants have enhanced yield-related traits relative to control plants. The invention also provides constructs comprising AUX/IAA-encoding nucleic acids, useful in performing the methods of the invention.

28 Claims, 40 Drawing Sheets

(51) Int. Cl.

| | |
|---|---|
| ***C12N 5/04*** | (2006.01) |
| ***A01H 5/10*** | (2006.01) |
| ***C07H 21/04*** | (2006.01) |
| ***C12N 15/82*** | (2006.01) |
| ***C07K 14/405*** | (2006.01) |
| ***C12N 15/52*** | (2006.01) |
| ***C07K 14/415*** | (2006.01) |

(52) U.S. Cl.

CPC .............. *C12N15/8251* (2013.01); *A01H 5/10* (2013.01); *C12N 15/52* (2013.01); *C12N 15/8222* (2013.01); *C07K 14/415* (2013.01); *C12N 9/1096* (2013.01); *C12N 15/8271* (2013.01); *C12N 15/8273* (2013.01); *C12N 15/8294* (2013.01); *C12N 15/8297* (2013.01)

(56) References Cited

U.S. PATENT DOCUMENTS

| | | | | |
|---|---|---|---|---|
| 2005/0044585 | A1 | 2/2005 | Good et al. | |
| 2007/0044171 | A1 | 2/2007 | Kovalic et al. | |
| 2007/0157337 | A1 | 7/2007 | Good et al. | |
| 2007/0214517 | A1 * | 9/2007 | Alexandrov et al. | 800/278 |
| 2008/0072340 | A1 | 3/2008 | Troukhan et al. | |

FOREIGN PATENT DOCUMENTS

| | | | |
|---|---|---|---|
| WO | WO-2005/103270 | A2 | 11/2005 |
| WO | WO-2006/076423 | A2 | 7/2006 |
| WO | WO-2009/037329 | A2 | 3/2009 |

OTHER PUBLICATIONS

Aubert, D., "Expression patterns of *GASA* genes in *Arabidopsis thaliana*: the *GASA4* gene is up-regulated by gibberellins in meristematic regions", Plant Molecular Biology, 1998, vol. 36, pp. 871-883.

Chen, Y., et al., "Transgenic expression of *DwMYB2* impairs iron transport from root to shoot in *Arabidopsis thaliana*", Cell Research, 2006, vol. 16, pp. 830-840.

De La Torre, F., et al., "Identification and functional analysis of a prokaryotic-type aspartate aminotransferase: implications for plant amino acid metabolism", The Plant Journal, 2006, vol. 46, pp. 414-426.

Fukaki, H., et al., "Lateral root formation is blocked by a gain-of-function mutation in the *SOLITARY-ROOT/IAA14* gene of *Arabidopsis*", The Plant Journal, 2002, vol. 29, No. 2, pp. 153-168.

Fukaki, H., et al., "Tissue-specific expression of stabilized *SOLITARY-ROOT/IAA14* alters lateral root development in *Arabidopsis*", The Plant Journal, 2005, vol. 44, pp. 382-395.

Gao, G., et al., "DRFT: a database of rice transcription factors", Bioinformatics Applications Note, 2006, vol. 22, No. 10, pp. 1286-1287.

Herzog, M., et al., "*GASA* a gibberellin-regulated gene family from *Arabidopsis thaliana* related to the tomato *GAST1* gene", Plant Molecular Biology, 1995, vol. 27, pp. 743-752.

Jain, M., et al., "Structure and expression analysis of early auxin-responsive *Aux/IAA* gene family in rice (*Oryza sativa*)", Funct. Integr. Genomics, 2006, vol. 6, pp. 47-59.

Jensen, R. A., et al., "Evolutionary recruitment of biochemically specialized subdivisions of family I within the protein superfamily of aminotransferases", Journal of Bacteriology, 1996, vol. 178, No. 8, pp. 2161-2171.

Jiang, C., et al., "Identification of conserved gene structures and carboxy-terminal motifs in the Myb gene family of *Arabidopsis* and *Oryza sativa* L. ssp. indica", Genome Biology, 2004, vol. 5, Issue 7, Article R46, pp. 46.1-46.11.

Klempnauer, K., et al., "Nucleotide sequence of the retroviral laukemia gene v-myb and its cellular progenitor c-myb: The architecture of a transduced oncogene", Cell, 1982, vol. 31, pp. 453-463.

Ko, C.-B., et al., "Enhanced tolerance to heat stress in transgenic plants expressing the *GASA4* gene", Plant Physiology and Biochemistry, 2007, vol. 45, pp. 772-728.

Lawlor, D. W., "Carbon and nitrogen assimilation in relation to yield: mechanisms are the key to understanding production systems", Journal of Experimental Botany, 2002, vol. 53, No. 370, pp. 773-787.

Li, S. F., et al., "Isolation of two novel *myb*-like genes from *Arabidopsis* and studies on the DNA-binding properties of their products", The Plant Journal, 1995, vol. 8, No. 6, pp. 963-972.

Ohta, M., et al., "Repression Domains of Class II ERF Transcriptional Repressors Share an Essential Motif for Active Repression", The Plant Cell, 2001, vol. 13, pp. 1959-1968.

Reed, J. W., "Roles and activities of Aux/IAA proteins in *Arabidopsis*", Trends in Plant Science, 2001, vol. 6, No. 9, pp. 420-425.

Remington, D., et al., "Contrasting modes of diversification in the *Aux/IAA* and *ARF* gene families", Plant Physiology, 2004, vol. 135, pp. 1738-1752.

Riechmann, J. L., et al., "*Arabidopsis* transcription factors: Genome-wide comparative analysis among eukaryotes", Science, 2000, vol. 290, pp. 2105-2110.

Rosinski, J. A., et al., "Molecular evolution of the myb family of transcription factors: Evidence for polyphyletic origin", Journal of Molecular Evolution, 1998, vol. 46, pp. 74-83.

Roxrud, I., et al., "GASA4, one of the 14-member *Arabidopsis* GASA family of small polypeptides, regulates flowering and seed development", Plant Cell Physiol., 2007, vol. 48, No. 3, pp. 471-483.

Sentoku, N., et al., "Analysis of the transgenic tobacco plants expressing *Panicum miliaceum* aspartate aminotransferase genes", Plant Cell Reports, 2000, vol. 19, pp. 598-603.

Shi, L., et al., "Characterization of a shoot-specific, $GA_3$- and ABA regulated gene from tomato", The Plant Journal, 1992, vol. 2, No. 2, pp. 153-159.

Stracke, R., et al., "The *R2R3-MYB* gene family in *Arabidopsis thaliana*", Current Opinion in Plant Biology, 2001, vol. 4, pp. 447-456.

Sun, Y., et al., "*Asymmetric Leaves1*, an *Arabidopsis* gene that is involved in the control of cell differentiation in leaves", Planta, 2002, vol. 214, pp. 694-702.

Taylor, B. H., et al., "A molecular marker for lateral root initiation: The *RSI-1* gene of tomato (*Lycopersicon esculentum* Mill) is activated in early lateral root primordia", Mol. Gen. Genet., 1994, vol. 243, pp. 148-157.

Wintz, H., et al., "Iron homeostasis in plants: when transcription affects translocation", Cell Research, 2006, vol. 16, pp. 797-798.

Zimmermann, I. M., et al., "Comprehensive identification of *Arabidopsis thaliana* MYB transcription factors interacting with R/B like BHLH proteins", The Plant Cell, 2004, vol. 40, pp. 22-34.

Murooka, Y., et al., "Variation of the Amino Acid Content of *Arabidopsis* Seeds by Expressing Soybean Aspartate Aminotransferase Gene," Journal of Bioscience and Bioengineering, 2002, vol. 94, No. 3, pp. 225-230.

"RecName: Full=Aspartate Aminotransferase; EC=2.6.1.1", UniProt Database Accession No. Q0JJ47, Oct. 3, 2006.

Partial European Search Report Dated Feb. 20, 2014 issued in European Application No. 13176669.3.

* cited by examiner

```
                1                                                50
100        (1)  ----------MASTMLSLASTTPSASLSMQEILKGKARLGSGSVSTLFNK
102        (1)  ----------MASTMISLASATPSASLSVQETLKGKMRLGSSSVSTLFNK
110        (1)  --------------------------------------------------
 76        (1)  ----------MASSFLSAASHAVSPSCSLSTTHKGKPMLGG---NTLRFH
112        (1)  ---------------MATAAAFSVSSPAASAVAARSKVFGG--VNQARTR
114        (1)  --------------------MALAMMIRNAASKRGMTP------------
118        (1)  ------------------------MAIRNSLTGQFLRR------------
170        (1)  -MAASTSSISRLGFRHHQPLGTNPGSHSQPSG--SVSFLSGSHCFYFKPL
172        (1)  MAATSTSTSYRLGFRLHQQLAPCSGSHPQTSG--AVSFLSGSHNFSFKSL
174        (1)  --MTAASSSSLLGSSRIGSGPTISGLHSDSLNPTSISFSSNLQGLSLRSS
176        (1)  --MTAASSSSLLGSSRIGSRPTISGLHSDSLNPRSITFSSTLQGLSLRSS
 44        (1)  --------------------------------------------------
  2        (1)  --------------------------------------------------
  4        (1)  ------------MPSANVRGAQPSADRRLSTLVRHLLPSSA----RTATT
 24        (1)  --MRPPVILKTTTSLLDSSSSSPPCDRRLNTLARHFLPQMA----S----
  6        (1)  --------------------------------------------------
 14        (1)  ----------MKTNDFSSSSSSSPSDRRIGALLRHLTA-------GTDAD
  8        (1)  ----------MKTTHFSSSSS---SDRRIGALLRHLNS-------GSDSD
 50        (1)  ----------MNPELTSPSSS---SDRRISVLARHLVG-------VEMDP
 54        (1)  -----------MHTQQSPSPS---ADRRLSVLARHLEPSSV----AVEGH
 62        (1)  --------------------------------------------------
Consensus  (1)                    S              R L

                51                                              100
100       (41)  EKGNPFIKAKSFGRISMTVAVNVSRFEGIAMAPPDPILGVSEAFRADTDV
102       (41)  EKGNPSIKKKSFGRISMTVAVNVSRFEGIAMAPPDPILGVSEAFRADIDV
110        (1)  ----------------MAIAVNTSRFEGVTMAPPDPILGVSEAFRADNSE
 76       (38)  KGPNSFSSSRSRGRISMAVAVNVSRFEGIPMAPPDPILGVSEAFKADNSD
112       (34)  TGCRVGITRKNFGRVMMALAVDVSRFEGVPMAPPDPILGVSEAFKADKSE
114       (19)  ----------ISGHFGGLR-SMSSWWKSVEPAPKDPILGVTEAFLADPSP
118       (15)  ----------SSVAGARLMSSSSSWFRSIEPAPKDPILGVTEAFLADQSP
170       (48)  EATRQSQLSRVSVVVKAESRSEEMQVDISLSPRVTAVKPSKTVAITDQAT
172       (49)  ETTRRSQLSRISVVVKAESRSEEMQLDISLSPRVNAVKPSKTVAITDQAT
174       (49)  GAKRQ-LYSRGTGSVVIAQNMDRVEVDLSLSPRVNSVKPSKTVAITDQAT
176       (49)  GSKRQ-LYSRGTGSVVIAQNMDRVEVDLSLSPRVNSVKPSKTVAITDQAT
 44        (1)  --------------------MAPSVFEHVQQAPEDPILGVTVAYNKDPSP
  2        (1)  -------------------MASSSVFAGLAQAPEDPILGVTVAYNKDPSP
  4       (35)  TSTSSSAADADSSLQAFPTMASSSVFAGLAQAPEDPILGVTVAYNKDPSP
 24       (41)  ---------HDS-ISASPTSASDSVFNHLVRAPEDPILGVTVAYNKDPSP
  6        (1)  ---------------------MDSVFSNVARAPEDPILGVTVAYNNDPSP
 14       (34)  RVSS------VFASPTSGGAG-GSVFAHLVQAPEDAILGVTIAYNKDPSP
  8       (31)  NLSS------LYASPTSGGTG-GSVFSHLVQAPEDPILGVTVAYNKDPSP
 50       (31)  QNDS------ISAFPTSGSDS-NSVFSHVVRGPEDPILGVTVAYNKDPSP
 54       (33)  SNHS------IVGAPTSGNDGKQSVFSHIVRAPEDPILGVTVAYNKDTSP
 62        (1)  ---------------MNSQHPDGSVFSNIVRAPEDPILGVTVAYNKDTSP
Consensus (51)              G          S F  I  AP DPILGVT AY  D SP
```

FIGURE 1

```
                101                                               150
      100  (91) KKLNLGVGAYRTEELQPYVLDVVKKAENLMLE-RGENKEYLPIEGLAAFN
      102  (91) KKLNLGVGAYRTEELQPYVLDVVKKAENLMLE-RGENKEYLAIEGLAAFN
      110  (35) MKLNLGVGAYRTEELQPYVLNVVKKAENLMLE-RGENKEYLPIEGLAAFN
       76  (88) VKLNLGVGAYRTEELQPYVLNVVKKAENLMLE-RGDNKEYLPIEGLAAFN
      112  (84) LKLNLGVGAYRTEELQPYVLNVVKKAENLMLE-KGENKEYLPIEGLAAFN
      114  (58) EKVNVGVGAYRDDNGKPVVLECVREAEKRLAG--STFMEYLPMGGSAKMV
      118  (55) NKVNVGVGAYRDDHGKPVVLECVREAERRVAG--SQFMEYLPMGGSIKMI
      170  (98) ALAQAGVPVIRLAAGEPDFDTPAVIAEAGINAIREGHTRYTPNAGTQELR
      172  (99) ALVQAGVPVIRLAAGEPDFDTPVVIAEAGINAIREGFTRYTPNAGTQELR
      174  (98) ALVQAGVPVIRLAAGEPDFDTPAPIAEAGINAIREGHTRYTPNAGTMELR
      176  (98) ALVQAGVPVIRLAAGEPDFDTPAPIAEAGINAIREGHTRYTPNAGTMELR
       44  (31) LKVNLGVGAYRTEEGKPLVLNVVRRAEQQLVADRSRNKEYQPITGISQFN
        2  (32) VKVNLGVGAYRTEEGKPLVLNVVRRAEQMLINNPSRVKEYLPITGLADFN
        4  (85) VKVNLGVGAYRTEEGKPLVLNVVRRAEQMLINNPSRVKEYLPITGLADFN
       24  (81) VKLNLGVGAYRTEEGKPLVLNVVRRVEQQLINDVSRNKEYIPIVGLADFN
        6  (30) VKINLGVGAYRTEEGKPLVLDVVRKAEQQLVNDPSRVKEYIPIVGISDFN
       14  (77) IKLNLGVGAYRTEEGKPLVLNVVRKAEQQLINDRSRIKEYLPIVGLVEFN
        8  (74) VKLNLGVGAYRTEEGKPLVLNVVRKAEQQLINDRTRIKEYLPIVGLVEFN
       50  (74) VKLNLGVGAYRTEEGKPLVLNVVRKAEQLLVNDRSRVKEYLPITGLAEFN
       54  (77) MKLNLGVGAYRTEEGKPLVLNVVRQAEQLLVNDRSRIKEYLPITGLADFN
       62  (36) IKLNLGVGAYRTEEGKPLVLNVVRRAEQLLVNDPSRVKEYLPIVGLAEFN
Consensus (101) VKLNLGVGAYRTEEGKPLVLNVVRKAEQ LI  RS  KEYLPI GLAEFN

                151                                               200
      100 (140) KVTAELLFGADNPVIKQQRVATVQGLSGTGSLRLAAALIERYFP-GAQVL
      102 (140) KVTAELLFGADNQVIEQQRVATVQGLSGTGSLRLAAALIERYFP-GAQVL
      110  (84) KVTAELLFGAGNPVIEQQRVATVQGLSGTGSLRLAAALIERYFP-GAKVL
       76 (137) KATAELLLGADNPAIKQQRVATVQGLSGTGSLRLGAALIERYFP-GAKVL
      112 (133) KATAELLLGADNPVINQGLVATLQSLSGTGSLRLAAAFIQRYFP-EAKVL
      114 (106) DLTLKLAYGDNSEFIKDKRIAAVQTLSGTGACRLFADFQKRFSP-GSQIY
      118 (103) EESLKLAFGDNSEFIKDKRIAAVQALSGTGACRLFAAFQQRFHP-NTQIY
      170 (148) VAICQKLKEENGISYKPD-----QILVSNGAKQSIYQAILAVCSPGDEVI
      172 (149) VAICHKLKEENGISYTPD-----QILVSNGAKQSIYQAMLAVCSPGDEVI
      174 (148) SAICHKLKEENGLSYTPD-----QIVVSNGAKQSIVQAVLAVCSPGDEVL
      176 (148) SAICHKLKEENGLSYTPD-----QIVVSNGAKQSIVQAVLAVCSPGDEVL
       44  (81) KLSAKLILGANSPAIAENRVATVQALSGTGALRVGAEFISRHYA-KPIIF
        2  (82) KLSAKLIFGADSPAIQENRVATVQCLSGTGSLRVGGEFLARHYH-ERTIY
        4 (135) KLSAKLIFGADSPAIQENRVATVQCLSGTGSLRVGGEFLARHYH-ERTIY
       24 (131) KLSAKLIFGADSPAIQDNRVTTVQCLSGTGSLRVGGEFLAKHYH-QRTIY
        6  (80) KLSAKLILGADSPAITESRVTTVQCLSGTGSLRVGAEFLKTHYH-QSVIY
       14 (127) KLSAKLILGADSPAIRENRVTTVECLSGTGSLRVGGEFLARHYH-QKTIY
        8 (124) KLSAKLILGADSPAIRENRITTVECLSGTGSLRVGGEFLAKHYH-QKTIY
       50 (124) KLSAKLMFGANCPAIQENRVTTVQCLSGTGSLRVGAEFLAKHHH-QRTIY
       54 (127) KLSAKLILGADSPAIQENRVTTVQCLSGTGSLRVGGEFLAQHYH-QRTIY
       62  (86) KLSAKLIFGADSPAIQENRVATVQGLSGTGSLRIGAEFLARHYY-QHTIY
Consensus (151) KLSAKLI GADSPAI ENRVATVQ LSGTGSLRVGAEFL RHY     IY
```

FIGURE 1 (continued)

```
                 201                                              250
      100 (189) ISSPTWGNHKNIFNDARVPWSEYRYYDPKTVGLDFEGMISDIKAAPEGSF
      102 (189) ISSPTWGNHKNIFNDARVPWSEYRYYDPKTVGLDFEGMISDIKAAPEGSF
      110 (133) ISSPTWGNHKNIFNDARVPWSEYRYYDPKTVGLDFDGMISDIKAAPEGSF
       76 (186) ISAPTWGNHKNIFNDASVPWSEYRYYDPKTVGLDFEGMIEDIKSAPEGSF
      112 (182) ISSPTWGNHKNIFNDARVPWSEYRYYDPKTVGLDFEGMIADIEAAPEGSF
      114 (155) IPVPTWSNHHNIWKDAQVPQKTYHYYHPETKGLDFSALMDDVKNAPEGSF
      118 (152) IPVPTWANHHNIWRDAGVPMKTFRYYHPESRGLDFSGLMDDIKNAPDGSF
      170 (193) IPAPFWVSYPEMARLADATPVILPTSISENFLLDPKQLESKLNEK---SR
      172 (194) IPAPFWVSYPEMARLADATPVILPTSISENFLLDPKLLESKLSAK---SR
      174 (193) IPAPYWVSYPEMARMADAMPVILPTSISEDFLLDPKLLESKLTEK---SR
      176 (193) IPAPYWVSYPEMARMADATPVILPTSISEDFLLDPKLLESKLTEK---SR
       44 (130) LPNPTWGNHNKIFPLGGVPQKPYRYYDPKTRGLDYEGMLEDLKAAPDGAV
        2 (131) IPQPTWGNHPKVFTLAGLTVRSYRYYDPATRGLDFQGLLEDLGSAPSGAI
        4 (184) IPQPTWGNHPKVFTLAGLTVRSYRYYDPATRGLDFQGLLEDLGSAPSGAI
       24 (180) LPTPTWGNHPKVFNLAGLSVKTYRYYAPATRGLDFQGLLEDLGSAPSGSI
        6 (129) IPKPTWGNHPKVFNLAGLSVEYFRYYDPATRGLDFKGLLEDLGAAPSGAI
       14 (176) IPQPTWGNHPKIFTLAGLSVKTYRYYDPSTRGLNFQGLLEDLSAAPQGSI
        8 (173) ITQPTWGNHPKIFTLAGLTVKTYRYYDPATRGLNFQGLLEDLGAAAPGSI
       50 (173) IPQPTWGNHPKIFTLAGLSVKTYRYYDPATRGLNFQGLVEDLNSAPSGAI
       54 (176) IPQPTWGNHTKIFALAGLSVKSYRYYDPATRGLHFQGLLEDLGSAPSGAI
       62 (135) IPVPTWGNHPKIFTIAGLSVKTYRYYDPETRGLDFKGLLEDLGAAPTGAI
Consensus (201) IP PTWGNHP IF LAGLS K YRYYDP TRGLDF GLLEDL AAP GS

                 251                                              300
      100 (239) VLLHGCAHNPTGIDPTPEQWEKIADVIQEK-NHVPFFDVAYQGFASGSLD
      102 (239) VLLHGCAHNPTGIDPTPEQWEKIADVIQEK-NHIPFFDVAYQGFASGSLD
      110 (183) VLLHGCAHNPTGIDPTPEQWEKIADVIQEK-NHIPFFDVAYQGFASGSLD
       76 (236) ILLHGCAHNPTGIDPTPEQWEKIADLIEEK-NHIPFFDVAYQGFASGSLD
      112 (232) VLLHGCAHNPTGIDPTPEQWEKIADVIQEK-KHMPFFDVAYQGFASGSLD
      114 (205) FLLHACAHNPTGVDPTEEQWREISQLFKAK-KHFAFFDMAYQGFASGDPA
      118 (202) FLLHACAHNPTGVDPSEEQWREISSQIKAK-GHFPFFDMAYQGFASGDPE
      170 (240) LLILCSPSNPTGSVYPKKLLEEIAKIVAKHPRLLVLSDEIYEHIIYAPAT
      172 (241) LLILCSPSNPTGSVYSKKLLEEIARIVAKHPRLLVLSDEIYEHIIYAPAT
      174 (240) LLILCSPSNPTGSVYPRKLLEEIAEIVARHPRLLVISDEIYEHIIYAPAT
      176 (240) LLILCSPSNPTGSVYPRKLLEEIAEIVARHPRLLVISDEIYEHIIYAPAT
       44 (180) ILLHACAHNPTGVDPTEEQWEGIRQVIRSK-HQLPFFDCAYQGFASGSLD
        2 (181) VLLHACAHNPTGVDPTLDQWEQIR--------------------------
        4 (234) VLLHACAHNPTGVDPTLDQWEQIRQLMRSK-ALLPFFDSAYQGFASGSLD
       24 (230) VLLHACAHNPTGVDPTLEQWEQIRQLIRSK-ALLPFFDSAYQGFASGSLD
        6 (179) VLLHACAHNPTGVDPTSEQWEQIRQLMRSK-SLLPFFDSAYQGFASGSLD
       14 (226) VLLHACAHNPTGVDPTLEQWEQIRKLMRSK-GLMPFFDSAYQGFASGSLD
        8 (223) VLLHACAHNPTGVDPTIQQWEQIRKLMRSK-GLMPFFDSAYQGFASGSLD
       50 (223) VLLHACAHNPTGVDPTSQQWEQIRKLMRSK-GLMPFFDSAYQGFASGSLD
       54 (226) VLLHACAHNPTGVDPTKDQWEQIRRLMRSK-GLLPFFDSAYQGFASGSLD
       62 (185) VLLHACAHNPTGVDPTLEQWEQIRQLMRSK-GLLPFFDSAYQGFASGSLD
Consensus (251) VLLHACAHNPTGVDPT EQWE IA LIRSK  LLPFFD AYQGFASGSLD
```

FIGURE 1 (continued)

| | | 301 350 |
|---|---|---|
| 100 | (288) | ADASSVRLFAARGMELLIAQS--------YSKNLGLYAERIGAINVVCSS |
| 102 | (288) | ADASSVRLFAARGMELLVAQS--------YSKNLGLYAERIGAINVVCSS |
| 110 | (232) | ADASSVRLFAARGMELLVAQS--------YSKNLGLYAERIGAINVVCSS |
| 76 | (285) | EDAASVRLFVARGIEVLVAQS--------YSKNLGLYAERIGAINVISSS |
| 112 | (281) | EDAFSVRLFVKRGMEVFVAQS--------YSKNLGLYSERVGAINVVCSA |
| 114 | (254) | RDAKSIRIFLEDGHHIGISQS--------YAKNMGLYGQRVGCLSVLCED |
| 118 | (251) | RDAKAIKIFLEDGHLIGLAQS--------YAKNMGLYGQRAGSLSVLCED |
| 170 | (290) | HTSFASLPGMWERTLTVNGFS----------KAFAMTGWRLGYLAGPKHF |
| 172 | (291) | HISFASLPGMWERTLTVNGFSKINIWKAGNLQAFAMTGWRLGYIAGPKHF |
| 174 | (290) | HTSFASLPGMWDRTLTVNGFS----------KAFAMTGWRLGYIAGPKHF |
| 176 | (290) | HTSFASLPGMWDRTLTVNGFS----------KAFAMTGWRLGYIAGPKHF |
| 44 | (229) | KDAHAVRLFVADGGECFVAQS--------YAKNMGLYGERVGALSVVCTN |
| 2 | (205) | -------------------------------------------------- |
| 4 | (283) | QDAQSVRMFVADGGELLMAQS--------YAKNMGLYGERVGALSIVCGS |
| 24 | (279) | ADAQPVRLFVADGGELLVAQS--------YAKNLGLYGERVGALSIVCKS |
| 6 | (228) | TDAQSVRTFVADGGECLIAQS--------YAKNMGLYGERVGALSIVCKS |
| 14 | (275) | TDAKPIRMFVADGGELLVAQS--------YAKNMGLYGERVGALSIVCKA |
| 8 | (272) | TDAKPIRMFVADGGECLVAQS--------YAKNMGLYGERVGALSIVCKS |
| 50 | (272) | ADAQPVRMFVADGGELLLAQS--------YAKNMGLYGERIGALSIVCKT |
| 54 | (275) | TDAQSVRMFVADGGEVLVAQS--------YAKNMGLYGERVGALSIVCRN |
| 62 | (234) | ADAQSVRMFVADGGECLAAQS--------YAKNMGLYGERVGALSIVCKA |
| Consensus | (301) | DA SVRLFVADG ELLVAQS        YAKNMGLYGERVGALSIVC S |

| | | 351 400 |
|---|---|---|
| 100 | (330) | ADAAARVKSQLKRIARPMYSNPPVHGARIVANVVGDPILFNEWKEEMEML |
| 102 | (330) | ADAAARVKSQLKRIARPMYSNPPVHGARIVANVVGDPALFNEWKAEMEMM |
| 110 | (274) | ADAAARVKSQLKRIARPMYSNPPIHGARIVANVVGDPALFNEWKEEMELM |
| 76 | (327) | PESAARVKSQLKRIARPMYSNPPVHGARIVADVVGNPVLFNEWKAEMEMM |
| 112 | (323) | PEVADRVKSQLKRLARPMYSNPPIHGAKIVANVVGDPTMFGEWKQEMELM |
| 114 | (296) | PKQAVAVKSQLQQLARPMYSNPPLHGAQLVSTILEDPELKSLWLKEVKVM |
| 118 | (293) | EKQAVAVKSQLQLIARPMYSNPPLHGALIVSTVLGDPDLKKLWLKEVKVM |
| 170 | (330) | VAACNKIQSQFTSGASSISQKAGVAALGLGYAGGEAVSTMVTAFRERRDF |
| 172 | (341) | VAACNKIQSQFTSGASSISQKAGVAALGLGYAGGEAVSTMVKAFMERRDF |
| 174 | (330) | VSACNKLQSQFTSGASSISQKAAVAALGLGYAGGEAVATMVKAFRERRDF |
| 176 | (330) | ISACNKLQSQFTSGASSISQKAAVAALGLGYAGGEAVATMLKAFHERRDF |
| 44 | (271) | AAVASRVDSQLKLVIRPMYSSPPAHGAAIAATILADGRLFQEWTVELKGM |
| 2 | (205) | -------------------------------------------------- |
| 4 | (325) | ADVAVRVESQLKLVIRPMYSNPPIHGASIVATILKDSAMFNEWTVELKGM |
| 24 | (321) | ADVASRVESQLKLVIRPMYSSPPIHGASIVAAILKDRNLFNDWTIELKAM |
| 6 | (270) | ADVASKVESQVKLVVRPMYSSPPIHGASIVATILKSSDMYNNWTIELKEM |
| 14 | (317) | ADVAGRVESQLKLVIRPMYSNPPIHGASIVAVILRDRNLFNEWTLELKAM |
| 8 | (314) | ADVAGRVESQLKLVIRPMYSSPPIHGASIVAVILRDKNLFNEWTLELKAM |
| 50 | (314) | ADVAGRVESQLKLVIRPMYSNPPIHGASIVAAILKDRDLYNEWTIELKAM |
| 54 | (317) | ADVTSRVESQLKLVIRPMYSNPPIHGASIVATILKDRNLYHEWTLELKAM |
| 62 | (276) | ADVASRVESQLKLVIRPMYSNPPIHGASIVATILKDSDMYNEWTLELKAM |
| Consensus | (351) | AD A RV SQLK VARPMYSNPPIHGA IVA IL D  LFNEW  ELK M |

FIGURE 1 (continued)

```
                 401                                              450
      100  (380) AGRIKNVRQKLFDSLS--AKDKSGKDWSFILKQIGMFSFTGLNKTQSENM
      102  (380) AGRIKNVRQKLFDSLS--AKDKSGKDWSFILKQIGMFSFTGLNKAQSDNM
      110  (324) AGRIKNVRQKLFDSLS--AKDKCGKDWSFILKQIGMFSFTGLSKVQSENM
       76  (377) AGRIKNVRQQLYDSIT--SKDKSGKDWSFILKQIGMFSFTGLNKNQSDNM
      112  (373) AGRIKNVRQKLYDSLS--AKDKSGKDWSFILRQIGMFSYTGLNKAQSDNM
      114  (346) ADRIIGMRTTLRESLE--KLGSPL-SWEHVTKQIGMFCYSGLTPEQVDRL
      118  (343) ADRIIGMRTTLRENLE--KKGSTL-PWQHITNQIGMFCYSGLTPEQVDRM
      170  (380) LIKSFGEMEGVGLSEPLGAFYLFIDFSSYYGAEVEGFGKIDDSDALCRYL
      172  (391) LIRSFGEMEGVRMSEPQGAFYLFIDTSSYYGTEAEGFGKIEDSDSLCRYL
      174  (380) LVKSFGEIDGVKISEPRGAFYLFIDLSSYYGVEVDGFGTINNSESLCRYL
      176  (380) LVKSFGEIDGVKISVPRGAFYLFIDLSSYYGVEVDGFGTVNNSESLCRYL
       44  (321) ADRIISMRQQLYDALQ--ARGTPG-DWTHVLKQIGMFTFTGLNKSQVEFM
        2  (205) --------------------------------------------------
        4  (375) ADRIISMRQQLFDALK--TRETPG-DWSHIIKQIGMFTFTGLNSDQVAFM
       24  (371) ADRIISMRQELFDALC--SRGTPG-DWSHIIKQIGMFTFTGLNAEQVSFM
        6  (320) ADRIKSMRQQLFEAIQ--ARGTPG-DWSHIIKQIGMFTFTGLNKEQVEFM
       14  (367) ADRIISMRKQLFEALR--ARGTPG-DWTHIIKQIGMFTFTGLNPAQVSYM
        8  (364) ADRIISMRKQLFEALR--TRGTPG-DWSHIIKQIGMFTFTGLNPAQVSFM
       50  (364) ADRIISMRQKLFEALH--ARGTPG-DWSHIVKQIGMFTFTGLNSKQVAFM
       54  (367) ADRIIRMRQQLFDALR--AKGTPG-DWSHIIKQIGMFTFTGLNKEQVAFM
       62  (326) ADRIISMRQLLFDTLR--DRGTPG-DWSHIIKQIGMFTFTGLNTEQVAFM
Consensus  (401) ADRI  MRQ LFDSL   AR T G DWSHIIKQIGMFTFTGLN  QV FM

                 451                                              500
      100  (428) TNKWHVYMTRDGRISLAGLSLAKCEYLADAIIDSYHNVS-----------
      102  (428) TNKWHVYMTKDGRISLAGLSLAKCEYLADAIIDSYHNVS-----------
      110  (372) TNKWHVYMTKDGRISLAGLSLAKCEYLADAIIDSFHCVS-----------
       76  (425) TNKWHVYMTKDGRISLAGLSLAKCEYLADAIIDSYHNVS-----------
      112  (421) TDKWHIYMTKDGRISLAGLSLAKCDYLADAIIDSFHNVN-----------
      114  (393) TSEYHIYMTRNGRISMAGVTTGNVGYLANAIHEVTKSS------------
      118  (390) TNEFHIYMTRNGRISMAGLNTGNVGYVADAIHEVTKSF------------
      170  (430) LDQAQVALVPGVAFGDDSCIRISYAASLTTLQAAVERIKKALLPLKSAVP
      172  (441) LDQAQVALVPGVAFGDDSCIRISYAASLTTLQEAVGRIKKALLPLKSAVP
      174  (430) LDKSQVALVPGDAFGDDTCIRISYAASLSTLQAAVERIKKALVTLRPPVP
      176  (430) LDKSQVALVPGDAFGDDTCIRISYAASLSTLQAAVERIKKALVTLKPPVP
       44  (368) TRQYHIYMTSDGRISMAGLSSKTVPHLADAIHAAVVGAQRKS--------
        2  (205) --------------------------------------------------
        4  (422) RQEYHIYMTSDGRISMAGLSGRTIPHLADAIHAAVTKLK-----------
       24  (418) TKEFHIYMTSDGRISMAGLSSKTVPLLADAIHAAVTRVV-----------
        6  (367) TKEFHIYMTSDGRISMAGLSSKTVPHLADAMHAAVTRLG-----------
       14  (414) TKEYHIYMTSDGRISMAGLSSKTVPHLADAIHAVVTKAL-----------
        8  (411) TKEYHIYMTSDGRISMAGLSSKTVPHLADAIHAVVTKAV-----------
       50  (411) TKEYHIYMTSDGRISMAGLSSKTVPHLADAMHAAVKRVV-----------
       54  (414) TKEYHIYMTSDGRISMAGLSSRTVPHLTDAIHAAVTRAR-----------
       62  (373) TKEYHIYMTSDGRISMAGLSSRTVPHLADAIHAAVTRIP-----------
Consensus  (451) T  YHIYMT DGRISMAGLS  TV HLADAIHAAV RV
```

FIGURE 1 (continued)

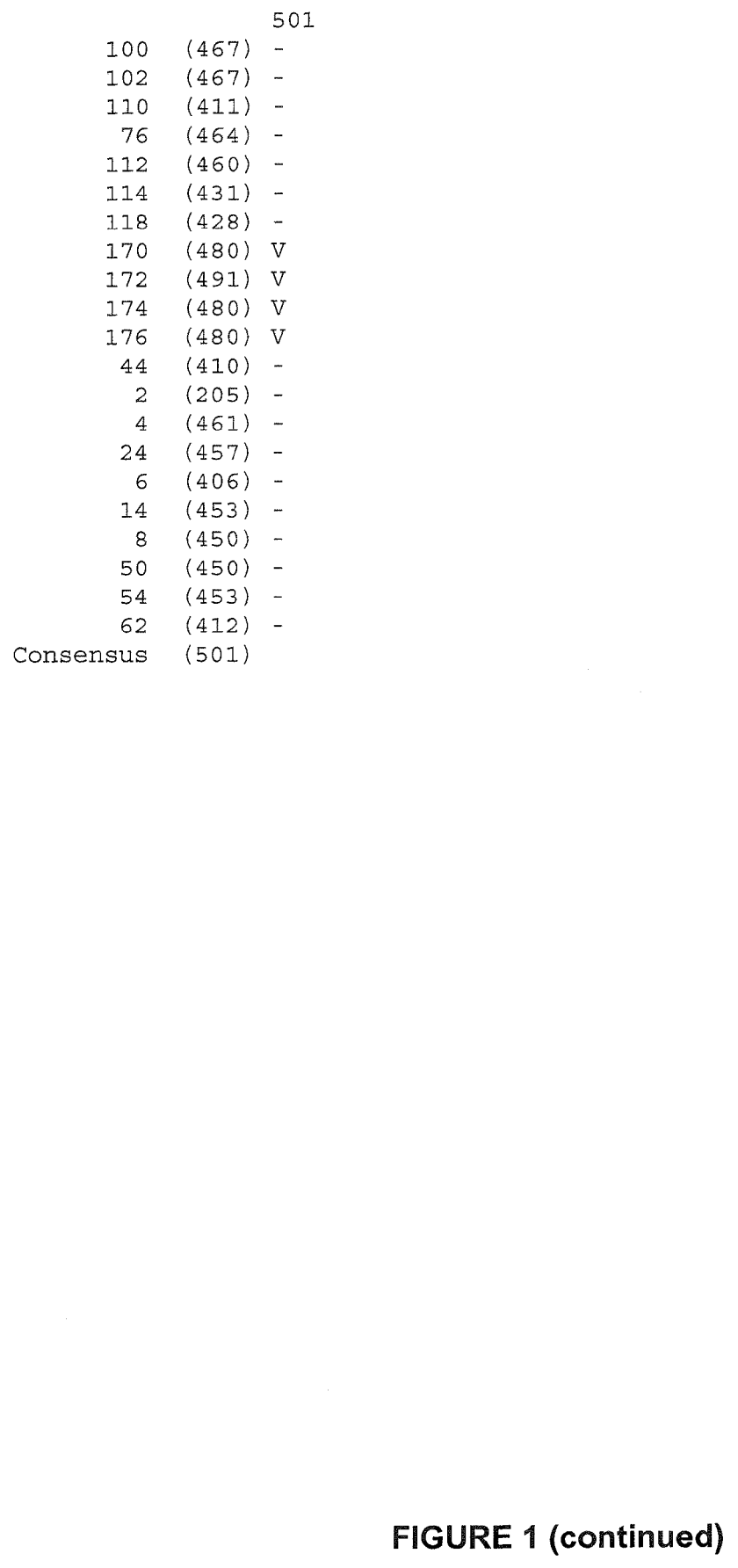

| | | 501 |
|---|---|---|
| 100 | (467) | - |
| 102 | (467) | - |
| 110 | (411) | - |
| 76 | (464) | - |
| 112 | (460) | - |
| 114 | (431) | - |
| 118 | (428) | - |
| 170 | (480) | V |
| 172 | (491) | V |
| 174 | (480) | V |
| 176 | (480) | V |
| 44 | (410) | - |
| 2 | (205) | - |
| 4 | (461) | - |
| 24 | (457) | - |
| 6 | (406) | - |
| 14 | (453) | - |
| 8 | (450) | - |
| 50 | (450) | - |
| 54 | (453) | - |
| 62 | (412) | - |
| Consensus | (501) | |

FIGURE 1 (continued)

```
CLUSTAL W (1.81) multiple sequence alignment

Poptr_MYB91                 -----MKERQRWRAEEDALLRAYVKQYGPREWNLVSQRMNTPLNRDAKSCLERWKNYLKP
Medtr_MYB91__PHAN_          --MSDMKDRQRWRAEEDALLRAYVKQYGPREWNLVSQRMNTPLNRDAKSCLERWKNYLKP
Pissa_MYB91                 -MSLEMKDRQRWRAEEDALLRAYVKQYGPREWNLVSQRMNTPLNRDAKSCLERWKNYLKP
Glyma_MYB91__PHANa_         -----MKDRQRWRAEEDALLRAYVKQYGPREWNLVSQRMNTPLNRDAKSCLERWKNYLKP
Glyma_MYB91__PHANb_         -----MKERQRWRAEEDALLRSYVKQYGPREWNLVSQRMNTYLNRDAKSCLERWKNYLKP
Lotco_MYB91__PHANb_         -----MKERQRWSSEEDALLHAYVQQYGPREWNLVSQRMNTPLNRDTKSCLERWKNYLKP
Lotco_MYB91__PHANa_         -----MKERQRWTSEEDALLCAYVKQYGPREWHLVSQRMNTTLHRDAKSCLERWKNYLKP
Eucgr_MYB91                 -----MKERQRWRAEEDALLRAYVKQYGPREWHLVSQRMNTPLNRDAKSCLERWKNYLKP
Maldo_MYB91                 -----MKERQRWSAEEDALLRAYVKQYGPREWNLVSQRMNTPLDRDAKSCLERWKNYLKP
Lyces_MYB91                 -----MRERQRWRAEEDALLRAYVRQYGPKEWPLVSQRMNTPLNRDAKSCLERWKNYLKP
Soltu_MYB91                 -----MRERQRWRAEEDALLRAYVRQYGPKEWHLVSQRMNTPLNRDAKSCLERWKNYLKP
Nicta_MYB91                 -----MRERQRWRSEEDALLRAYVKQYGPKEWHLVSQRMNTALNRDAKSCLERWKNYLKP
Vitvi_MYB91                 -----MKERQRWRAEEDALLRAYVRQYGPREWNLVSQRMNTPLDRDAKSCLERWKNYLRP
Goshi_MYB91                 -----MKERQRWRAEEDALLCAYVKQYGPREWNLVSHRMNTPLNRDAKSCLERWNNYLKP
Aqufo_MYB91                 -----MKERQRWRAEEDALLRAYVKQYGPREWNLVSQRMNTPLDRDAKSCLERWKNYLKP
Escca_MYB91                 -----MKERQRWRAEEDALLRAYVKQYGPREWNLVSQRMNTHLDRDAKSCLERWKNYLKP
Arath_AS1_MYB91             -----MKERQRWSGEEDALLRAYVRQFGPREWHLVSERMNKPLNRDAKSCLERWKNYLKP
Carhi_MYB91                 -----MKERQRWSGEEDALLRAYVRQFGPREWHLVSERMNKPLNRDAKSCLERWKNYLKP
Brana_MYB91                 -----MKERQRWSGEEDALLRAYVRQFGPREWHLVSERMNKPLNRDAKSCLERWKNYLKP
Antma_MYB91                 -----MKERQRWRPEEDALLRAYVKEYGPRDWHLVTQRMNKPLNRDAKSCLERWKNYLKP
Orysa_MYB91                 MQPPPMRERQRWRPEEDAILLAYVRQYGPREWSLVSQRMNRPLHRDAKSCLERWKNYLRP
Zeama_MYB91__RS2_           -----MKERQRWRPEEDAVLRAYVRQYGPREWHLVSQRMNVALDRDAKSCLERWKNYLRP
Moral_MYB91                 -----MKERQRWQPEEDALLRAYVKQYGPRDWNLVYQRMGKPLHRDPKSCLERWKNYLKP
                                 *::****  ****:* :**:::**::* **  .**.  *.**.*******:***:*
IPR015495 MYB family                    XXXXXXXXXXXXXXXXXXXXXXXXXXXXXXXXXXXXXXXXXXXXXXXXX
IPR014778 MYB domain                 XXXXXXXXXXXXXXXXXXXXXXXXXXXXXXXXXXXXXXXXXXXXXXXXXX


Poptr_MYB91                 GIKKGSLTEEEQSLVIRLQAKHGNKWKKIAAEVPGRTAKRLGKWWEVFKEKQQR-ELKEN
Medtr_MYB91__PHAN_          GIKKGSLTEEEQRLVISLQATHGNKWKKIAAQVPGRTAKRLGKWWEVFKEKQQRETKGSI
Pissa_MYB91                 GIKKGSLTEEEQHLVISLQATHGNKWKKIAAQVPGRTAKRLGKWWEVFKEKQQRETKG-I
Glyma_MYB91__PHANa_         GIKKGSLTEEEQRLVINLQATHGNKWKKIAAQVPGRTAKRLGKWWEVFKEKQQRETKG-N
Glyma_MYB91__PHANb_         GIKKGSLTEEEQRLVIHLQAKYGNKWKKIAAEVPGRTAKRLGKWWEVFKEKQQREKKE-I
Lotco_MYB91__PHANb_         GIKKGSLTKEEQRLVILLQANYGNKWKKIAAEVPGRTAKRLGKWWEVYKEKQQREKIE-I
Lotco_MYB91__PHANa_         GIKKGSLTEEEQRLVIRLQAKHGNKWKKIAAEVPGRTAKRLGKWWEVFKEKQQREKQE-I
Eucgr_MYB91                 GIKKGSLSEEEQRLVIQLQAKHGNKWKKIAAEIPGRTAKRLGKWWEVFKEKQQR-EQKEN
Maldo_MYB91                 GIKKGSLTEEEQRLVICLQAKHGNKWKKIAAEVPGRTAKRLGKWWEVFKEKQQR-EQKNK
Lyces_MYB91                 GIKKGSLTEDEQRLVIQLQAKHGNKWKKIAAEVPGRTAKRLGKWWEVFKEKQQR-EQKEN
Soltu_MYB91                 GIKKGSLTEDEQRLVIQLQAKHGNKWKKIAAEVPGRTAKRLGKWWEVFKEKQQR-EQKEN
Nicta_MYB91                 GIKKGSLTQEEQRLVIHLQAKHGNKWKKIAAEVPGRTAKRLGKWWEVFKEKQHR-EQKEN
Vitvi_MYB91                 GIKKGSLTEEEQRLVIRLQAKHGNKWKKIAAEVPGRTAKRLGKWWEVFKEKQQR-EQKEN
Goshi_MYB91                 GIKKGSLTEEEQRLVIRLQAKHGNKWKKIAAEVPGRTAKRLGKWWEVFKEKQQR-EHKEK
Aqufo_MYB91                 GIKKGSLTEEEQRLVIRLQAKHGNKWKKIAAEVPGRTAKRLGKWWEVFKEKQQR-EQKEN
Escca_MYB91                 GIKKGSLTEEEQRLVIRLQAKHGNKWKKIAAEVPGRTAKRLGKWWEVFKEKQQR-EQKET
Arath_AS1_MYB91             GIKKGSLTEEEQRLVIRLQEKHGNKWKKIAAEVPGRTAKRLGKWWEVFKEKQQR-EEKES
Carhi_MYB91                 GIKKGSLTEEEQRLVIRLQEKHGNKWKKIAAEVPGRTAKRLGKWWEVFKEKQQR-EEKES
Brana_MYB91                 GIKKGSLTEEEQRLVIRLQEKHGNKWKKIAAEVPGRTARRLGKWWEVFKEKQQR-EEKES
Antma_MYB91                 GIKKESLTQEEQILVINLQAKHGNKWKKIAAEVPGRTAKRLGKWWEVFKEKKQR-EEKDN
Orysa_MYB91                 GIKKGSLTDDEQRLVIRLQAKHGNKWKKIAAEVPGRTAKRLGKWWEVFKEKQQRELRDRD
Zeama_MYB91__RS2_           GIKKGSLTEEEQRLVIRLQAKHGNKWKKIAAEVPGRTAKRLGKWWEVFKEKQQRELRDS-
Moral_MYB91                 GLKKGSLTPEEQSLVISLQAKYGNKWKKIAAEVPGRTAKRLGKWWEVFKEKQLKQLQLQK
                            *:** **: :** *** ** .:*********::*****:********:***: :
IPR015495 MYB family        XXXXXXXXXXXXXXXXXXXXXXXXXXXXXXXXXXXXXXXXXXXXXXXXXXXXXXXXXXXX
IPR014778 MYB domain           XXXXXXXXXXXXXXXXXXXXXXXXXXXXXXXXXXXXXXXXXXXXX
```

FIGURE 5

```
Poptr_MYB91              NKTVEPIDE-------------------GKYDRILETFAEKLVKERP----SPAFVMATS
Medtr_MYB91__PHAN_       NRTVDPIND-------------------SKYEHILESFAEKLVKERP----SPSFVMAAS
Pissa_MYB91              NKTVDPIND-------------------SKYEHILESFAEKLVKERP----SPSFVMAAS
Glyma_MYB91__PHANa_      SCTIDPISD-------------------SKYEHILESFAEKLVKERPSTSTSTSFVMATS
Glyma_MYB91__PHANb_      NRIADPINN-------------------SKYEHILESFAEKLVKERP----SPSFVMAAS
Lotco_MYB91__PHANb_      NGIVSPISD-------------------TKYEHMLEGFAEKLVKEHT----LPSFAMAAS
Lotco_MYB91__PHANa_      SKSIGPVDD-------------------SKYDHILETFAEKLVKEHP----SPSYLMAAS
Eucgr_MYB91              -KGALPIDE-------------------GKYDHILENFAEKLVKERS----TPALLMATA
Maldo_MYB91              -KITDPIVE-------------------GKYDTILETFAEKLVKER-----APTYLMATS
Lyces_MYB91              NKVVDPVDE-------------------GKYDHILETFAEKIVKERS----VPGLLMATS
Soltu_MYB91              NKVVDPVDE-------------------GKYDHILETFAEKIVKERS----VPGLLMATS
Nicta_MYB91              NKVVDPVDE-------------------GKYDHILETFAEKIVKERS----VPGLLMATS
Vitvi_MYB91              NKVVDPIEE-------------------GKYDRILETFAEKLVKERP----APAFLMATS
Goshi_MYB91              HKTVEPVEE-------------------GKYDRILETFAEKLVKQGH----SSAFPMAAS
Aqufo_MYB91              NKAPEPIEE-------------------GKYDSILETFAEKLVKECP----NPPFLMATS
Escca_MYB91              SKTIDPIEE-------------------GKYDQILETFAEKLVKERP----NPPLYMGTS
Arath_AS1_MYB91          NKRVEPIDE-------------------SKYDRILESFAEKLVKERSN-VVPAAAAAATV
Carhi_MYB91              NKRVEPIDE-------------------SKYDRILESFAEKLVKERSNNIVVVPPSAGKV
Brana_MYB91              NKRVEPIDE-------------------SKYDRILESFAEKLVKERSS----VPSAVMAS
Antma_MYB91              KKITEPIEE-------------------GKYDRILETFAEKIVKERVVS--RIITMPPTS
Orysa_MYB91              RRRLPPPLDGDERGCAG-----------GRYDWLLEDFADKLVNDHHR--------RMMA
Zeama_MYB91__RS2_        -RRPPPEPSPDER---------------GRYEWLLENFAEKLVGERPQQAAAAPSPLLMA
Moral_MYB91              KPPSQPDGNIPVAVAVAGGSSPADKAVQGPYDHILETFAEKYVHQQRP---NLNPAILPV
                              *                        *:  :** **:*  *  :

IPR015495 MYB            XXXXXXXXX


Poptr_MYB91              NGTFLHPHPHPPPHPHPSTPAPTMLPPWLSNSNS----------TSTVRPPSPSVTLSLS
Medtr_MYB91__PHAN_       NSSYLHTDAQAP--------TPGLLPSWLSNSNN----------AAPVRPNSPSVTLSLS
Pissa_MYB91              NSSYLHTDAQAA--------TPGLLPSWLSNSNN----------TAPVRPNSPSVTLSLS
Glyma_MYB91__PHANa_      NSSFLHADAPAP--------APALLPSWLSNSNG----------TAPVRPPSPSVTLSLS
Glyma_MYB91__PHANb_      DGAFLLTDTPAP--------ASSLRPSWLSNSSS----------AAAIGPSSLSVKLSLS
Lotco_MYB91__PHANb_      SNEAFLHTN-----------SSAMLPSWLSNYDS----------TSTP-PSSISVTLSLS
Lotco_MYB91__PHANa_      NGPFLHTDTPAATP------ASALLPPWLSNSSNNP--------ATAGQPPSPSVTLSLS
Eucgr_MYB91              NGGFIHTDSPALAP--------TLLPPWLSNSNG----------TPTLRPPSPSVTLSLS
Maldo_MYB91              NGAYLHTETSSPAP--------TILPPWLSNSNV----------SPNVRPPSPSVTLSLS
Lyces_MYB91              NGGFLHADASTPTPQ-------TLLPPWLSNSSA----------PSTVRSSSPSVTLSLS
Soltu_MYB91              NGGFLHSDASTPTPQ-------NLLPPWLSNSTA----------PSTVRSSSPSVTLSLS
Nicta_MYB91              NGGFLHADAPAPSPQ-------TLLPPWLSNSTA----------TSTVRSPSPSVTLSLS
Vitvi_MYB91              NGNFLHPDPPAP-------PPPTLLPPWLSNSNC----------TSTVRPPSPSVTLSLC
Goshi_MYB91              NGGFLHTDPPSP-------APPTLLPPWLSNSSN----------ASVVTPPSPSVTLSLS
Aqufo_MYB91              NGGFLHS-DPPAPPP-------TMLPPWMASSNG-----------TTVRPSSPSVTLTLS
Escca_MYB91              NGGYLQSNAATVPPP-------TLLPPWLSSSSA-----------PPTTSSPPSVTLTLS
Arath_AS1_MYB91          VMANSNGGFLHSEQQVQP--PNPVIPPWLATSNNGN--------NVVARPPSVTLTLSPS
Carhi_MYB91              VMANSNGGFLQHSEQTQPQPPNPVIPPWLATSNNGN--------NVVVRPPSVTLTLSPS
Brana_MYB91              SNGGFQQAPPNNNNNNNNNNNNHVIPPWLATSNNGS--------NVVARPPSVTLTLSPS
Antma_MYB91              NSGFLQNDPSPHSAQS-------VLPPWLASSSMT----------TTIRPQSPSVTLSLS
Orysa_MYB91              AP---------------------ILPPWMSS--------------SPSSSSSPSVTLSLA
Zeama_MYB91__RS2_        AP---------------------VLPPWLSSNAGPAAAAAAAVAHPPPRPPSPSVTLSLA
Moral_MYB91              VPFPMPNPDPVLSLGSVNSTPPPALPPWMNLNVNVN-------ATTSSLSSCTTSSSAT
                                                  *.*:                       . : . :
```

FIGURE 5 (continued)

```
Poptr_MYB91              PSTVAAS----------PPIPWLQPERGPENTPLVLGNLPPHGIVPVCGESFLMSELVDC
Medtr_MYB91__PHAN_       PS----------TVAAPPPWMQPVRGPDN--APLVLGNVAPHGAVLSYGESMVMSELVDC
Pissa_MYB91              PS----------TVAAPPPWMQPVRGPDN--APLVLGNVAPHGAVLSYGENMVMSELIDC
Glyma_MYB91__PHANa_      PS----------TVAAPPPWMQPPVRGQDNASPLVLGNVAPHGAVLAFGENMVMSELVEC
Glyma_MYB91__PHANb_      SS----------TVATPPFSWLPPERGPDNAPFVLGNVSALHGAIPTLSDSMHMSQMVEH
Lotco_MYB91__PHANb_      PS----------TVATPRG-------LENNAPFVLRNVTAHNGSVPSFSDHILMSELVGF
Lotco_MYB91__PHANa_      PS----------TVAGPPPPWRG---LENNALAMAN--TAPHGTVPAFSDNMLVSELVDC
Eucgr_MYB91              P-----ATVPAS-----QPIPWLQADRGLDSGSLSLTGLPNHGPLPTSGENILMSELAEC
Maldo_MYB91              P-----TVAPS------PPIPWLQQDRGSD-GSFVVGNLPHHGVVPACGENLVISELVEC
Lyces_MYB91              P-----STVP---PTPTPGIPWLQTDRGPDNAPLILSSFPHHSVAP-CGENPFITELAEC
Soltu_MYB91              P-----STVP---PTPTPGIPWLQTDRGPDNASLILSSFPHHGVAPPCGENPFITELAEC
Nicta_MYB91              P-----STVPP-TPTPTPGIPWLQTDRGPENAPLILSSFPHHGVAPPCGENPFVTELVEC
Vitvi_MYB91              PSTVATS----------PTIPWLQPERGPDATPLVLGNLPPHGAVPTSGENLLISELVEC
Goshi_MYB91              PSTVAAA----------PPIPWLQPER-MSETSPVLGNRVPHGSFPRS-ENLLISELMDC
Aqufo_MYB91              PS------TVTPPPSIPWLQSADRGAAENPSLGLG--SLSSHGSGSTGGDNHMVADLVEC
Escca_MYB91              PS------TIAPCTSMSWLQPDRGGNDSNPSLVLGNFPPTHVPVPPSGGDRLMVPDLVEC
Arath_AS1_MYB91          TVAAAAPQPP-----IPWLQQQQPERAENGPGGLVLGSMMPSCSGSS--ESVFLSELVEC
Carhi_MYB91              TLAASTPPPPQ----IPWLQQQQ--QPERGENGLVLGSMMPSCSGSSSSESVFLSELVEC
Brana_MYB91              VAATPPQQQP-----IPWLQQQQ---PEASPGGLVLGSMIPSCSGSN--ESVFMSELVEC
Antma_MYB91              PS-------------VVPPAPAIPWLHPDNTTHGPSNLSSLGVVAPFMGENHIVPELLEC
Orysa_MYB91              SAAVAPAPAAP----PPTWGG-------------------------GGGGEVVVAELMEC
Zeama_MYB91__RS2_        SAAVAPGPPAP----APWMPDRAAADAAPYGFPSPSQHGGAAPPGMAVVDGQALAELAEC
Moral_MYB91              PS---------------------PSVSLSLSPSEPVQQQTLEQEMNRFLPVQQMASIFQC
                                                                              :..:
Conserved Domain (CD)                                                         XXXXXX
```

```
Poptr_MYB91              CRELEEGHRAWAAHKKEAAWRLRRVELQLESERSCRRREKMEEIESKIKSLREEEKASLD
Medtr_MYB91__PHAN_       CKELEEVHHALAAHKKEAAWRLSRVELQLESEKASRRREKMEEIEAKIKALREEQAVALD
Pissa_MYB91              CKELEEGHHALAAHKKEAAWRLSRVELQLESEKASRRREKMEEIEAKIKALREEQAVALD
Glyma_MYB91__PHANa_      CKELDEVHHALAGHKKEAAWRLSRVELQLESEKAGRRREKMEEIEAKIKALREEQTAALD
Glyma_MYB91__PHANb_      CKELEEGHRALATHKKEAAWRLSRVELQLESEKANRRREKIEEFEAKIKALQEEEKAALG
Lotco_MYB91__PHANb_      SKELEEGHRALAAHKKEAEWRLRRLELQLESEKACRRRETVEEFEANIKALQEEQTAALN
Lotco_MYB91__PHANa_      CKELEEVHGALAAHKKEATWRLRRVELQLESEKANRRREKIEETEAKIKALREQQNAALE
Eucgr_MYB91              CKELEEGHRAWAAHKKEAAWRLKRLELQLESEKACRRREKMEEIEAKINTLREEQKASLD
Maldo_MYB91              SRELEEMHRAWAAHKKEASWRLRRVELQLDSEKACRRREKMEEIEAKVKALREEQKAALD
Lyces_MYB91              CKDLDEGHRTWTAHKKEAAWRLRRVELQLESEKASKVREKMEEIEAKMKALREEQKATLD
Soltu_MYB91              CKDLDEGHRTWTAHKKEATWRLRRVELQLESEKASKVREKMEEIEAKMKALREEQKATLD
Nicta_MYB91              CKELDEGHRAWAAHKKEAAWRLRRVELQLESEKICKVREKMEEIEAKMKALREEQKATLD
Vitvi_MYB91              CRELEEGHRAWAAHKKEAAWRLRRVELQLESEKACRRREKMEEIESKVKALREEQKATLD
Goshi_MYB91              CRQLEDGRRAWVAHRKEAAWRLRRVELQLESEKASRKRKKMEEIESKIEALREEQKSTLD
Aqufo_MYB91              CRELEEGHRAWVAHKKEAAWRLKRVELQLESEKACRRRDKMEEIESKIRALRDEQKVTLE
Escca_MYB91              CRELEESHRALVAHKKEAAWRLKRVELQLESEKACRRREKMEEIEMKVRALREEQKVTLD
Arath_AS1_MYB91          CRELEEGHRAWADHKKEAAWRLRRLELQLESEKTCRQREKMEEIEAKMKALREEQKNAME
Carhi_MYB91              CRELEEGHRVWSEHKKEAAWRLRRLELQLESEKTCRQREKMEEIEAKMKALREEQKIAME
Brana_MYB91              CRELEEGHRAWAEHKKEAAWRLRRLELQLESEKTSRQREKTEEIEAKMKALREEQKMAME
Antma_MYB91              CRELEEGQRAWAAHRKEAAWRLKRVELQLESEKACRRREKMEEIEAKMKALREEQKASLD
Orysa_MYB91              CREMEEGQRAWAAHRKEAAWRMKRVEMQLETERACRRREATEEFEAKMRALREEQAAAVE
Zeama_MYB91__RS2_        CRELEEGRRAWAAHRREAAWRLKRVEQQLEMEREMRRREVWEEFEAKMRTMRLEQAAAAE
Moral_MYB91              CKELEEGRQSWLQHKKEATWRPSRLEQQLESEKSKKRKEKMEEIDAKIRSLREEEMAFLS
                         .::::: :      *::** **  *:* **: *:  : :.  ** : ::.::: ::
Conserved Domain (CD)    XXXXXXXXXXXXXXXXXXXXXXXXXXXXXXXXXXXXXXXXXXXXXXXXXXXXXXXXXXXX
```

FIGURE 5 (continued)

```
Poptr_MYB91              RIEAEYREQLTGLRRDAETKEQKLSDQWTAKHLRLTKFLEQMSCRPRLSEPNSR------
Medtr_MYB91__PHAN_       RIEGEYREQLAGLRRDAETKEQKLTEQWAAKHLRLTKFLEQVGCRSRHAESNGR------
Pissa_MYB91              RIEGEYREQLAGLRRDAEAKEQKLAEQWAAKHLRLTKFLEQVGCRSRHAEQNGR------
Glyma_MYB91__PHANa_      RIEAEYREQLAGLRRDAESKEQKLAEQWAAKHLRLTKFLEQVGCRSRLTEPNGR------
Glyma_MYB91__PHANb_      RIEAEYREQLAALRRDAENKEQKLAEQWDAKHLRFTRLLEQLGCRAGLLEPNAR------
Lotco_MYB91__PHANb_      RIENACREQLGGLRRDAESKEQKLAEKWTSKHLRLTRLLEQMKIQTGAP-----------
Lotco_MYB91__PHANa_      RIEAEYREQLAGLRRDAETKEQKLAEQWTVKHSRLMKFMEQIGCRSRIAETNGR------
Eucgr_MYB91              KIETEYREQLAGLRKDAESKEQKLAEQWTAKHVQLSKLIEQIGFRPRIADHDRQ------
Maldo_MYB91              RIEAEYREQLAGLRRDAEAKEQKLAEQWAAKHLRLSQFLEQMGGRPRIVEPNGR------
Lyces_MYB91              RIEAEYKEQLAGLRRDAEAKEQKLAEQWTSKHMRLAKFLEQMGCQSRLAEPNGGR-----
Soltu_MYB91              RIEAEYKDQLAGLRRDAEAKEQKLAEQWTSKHMRLAKFLEQMGCQSRLAEPNGGR-----
Nicta_MYB91              RIEAEYKEQLAGLRRDAEAKEQKLAEQWASKHLRLSKFLEQMGCQSRLAEPNGGR-----
Vitvi_MYB91              RIEAEYREQLAGLRRDAESKEQKLAEQWSAKHLRLTKFIEQMGCRPRLAEPNGR------
Goshi_MYB91              RIEAEYREQLEGLRRDAEAKEQKLAEQWAAKHLHLTKFLEQTGCRPRVVEPNGQ------
Aqufo_MYB91              RIEAEYREQLAGLRRDADAKEQKLADQWAGKHMRLTKFLEQMGCRPRLIEPNGR------
Escca_MYB91              RMEADYRDQLAGLRRDAEAKEQKLADQWAAKHLRLMKFLEQIGCRP-PSEPSGR------
Arath_AS1_MYB91          KIEGEYREQLVGLRRDAEAKDQKLADQWTSRHIRLTKFLEQQMGCRLDRP----------
Carhi_MYB91              KIDGEYREQLVGLRRDAEAKDQKLADQWTSKHIRLTKFLEQNMGCRLDRP----------
Brana_MYB91              KIEGEYREQLVGLRRDAEAKDQKLADQWTSKHIRLTKFLEQHMGCRQRLLDRP-------
Antma_MYB91              RIEAEYREQLAGLRREAEVKEQKLAEQWAAKHLRLTKFLEQTGYRSIAGELNGR------
Orysa_MYB91              RVEAEYREKMAGLRRDAEAKEQKMAEQWAAKHARLAKFLDQVAACRRWPPVEINGGGGGG
Zeama_MYB91__RS2_        RVERDHREKVAELRRDAQVKEEKMAEQWAAKHARVAKFVEQMGGCSRSWSSATDMNC---
Moral_MYB91              RIEGEYREQLLALQRDAEAKEAKLVEAWCGKHVKLAKLLDQIGAHHCCNATNGFTAFPNP
                         :::   ::::  *:::*: *: *: : *  :* :. ::::*
Conserved Domain (CD)    XXXXXXXXXXXXXXXXXXXXXXXXXXXXXXXXXXXXXXXXX
```

```
Poptr_MYB91              -----
Medtr_MYB91__PHAN_       -----
Pissa_MYB91              -----
Glyma_MYB91__PHANa_      -----
Glyma_MYB91__PHANb_      -----
Lotco_MYB91__PHANb_      -----
Lotco_MYB91__PHANa_      -----
Eucgr_MYB91              -----
Maldo_MYB91              -----
Lyces_MYB91              -----
Soltu_MYB91              -----
Nicta_MYB91              -----
Vitvi_MYB91              -----
Goshi_MYB91              -----
Aqufo_MYB91              -----
Escca_MYB91              -----
Arath_AS1_MYB91          -----
Carhi_MYB91              -----
Brana_MYB91              -----
Antma_MYB91              -----
Orysa_MYB91              PGGGR
Zeama_MYB91__RS2_        -----
Moral_MYB91              N----
```

FIGURE 5 (continued)

<u>MEKTLSLVLILPLLIMLLLVGTHA</u>KIII

ESPAPQPQPPNTLPMNGTTPGSLHPQDC

LPKCTYRCSNTQYRKPCMFFCQKCCAKC

LCVPAGTYGNKQFCPCYNNWKTKRGGPK

```
CLUSTAL 2.0.9 multiple sequence alignment

Os05g0432200            ------------------------------------------------------------
AK110640                ------------------------------------------------------------
TA53297_4565            ------------------------------------------------------------
TA52915_4565            ------------------------------------------------------------
scaff_41.75             ------------------------------------------------------------
TA52374_4081            ------------------------------------------------------------
TA5035_4679             ------------------------------------------------------------
Os09g0414900            ------------------------------------------------------------
GASA6                   ------------------------------------------------------------
scaff_XVII.377          ------------------------------------------------------------
TA56938_4081            ------------------------------------------------------------
GASA4                   ------------------------------------------------------------
Os05g0376800            ------------------------------------------------------------
scaff_VI.397            ------------------------------------------------------------
scaff_I.1483            ------------------------------------------------------------
BG128975                ------------------------------------------------------------
BG130916                ------------------------------------------------------------
TA52635_4081_SEQID2_    ------------------------------------------------------------
TA5923_4679             ------------------------------------------------------------
Os06g0266800            ------------------------------------------------------------
TA100367_4565           ------------------------------------------------------------
CA725087                ------------------------------------------------------------
TA77646_4565            ------------------------------------------------------------
TA92393_4565            ------------------------------------------------------------
CK153563                ------------------------------------------------------------
BI208422                ------------------------------------------------------------
TA37180_4081            ------------------------------------------------------------
scaff_II.2328           ------------------------------------------------------------
scaff_II.2330           ------------------------------------------------------------
GASA5                   ------------------------------------------------------------
GASA12                  ------------------------------------------------------------
Os10g0115550            ------------------------------------------------------------
TA101332_4565           ------------------------------------------------------------
TA56201_4081            ------------------------------------------------------------
AJ785329                ------------------------------------------------------------
AK105729                ------------------------------------------------------------
Os03g0760800            ------------------------------------------------------------
TA66036_4565            ------------------------------------------------------------
BM136027                ------------------------------------------------------------
CA705831                ------------------------------------------------------------
CA593033                ------------------------------------------------------------
TA66038_4565            ------------------------------------------------------------
CD899399                ------------------------------------------------------------
Os03g0607200            ------------------------------------------------------------
scaff_IX.735            ------------------------------------------------------------
scaff_I.2410            ------------------------------------------------------------
Pop_GASA_               ------------------------------------------------------------
scaff_40.379            ------------------------------------------------------------
TA45751_4081            ------------------------------------------------------------
scaff_205.30            ------------------------------------------------------------
TA69823_4565            MYVGFNXXWRFTXNDKXHIINVKAXXCHICSNQNKELPAPKSSNDDFTLSLCDISMQGTG
TA69821_4565            ------------------------------------------------------------
Os07g0592000            ------------------------------------------------------------
Os04g0465300            ------------------------------------------------------------
scaff_II.204            ------------------------------------------------------------
scaff_II.202            ------------------------------------------------------------
TA35962_4081            ------------------------------------------------------------
scaff_II.203            ------------------------------------------------------------
BE353147                ------------------------------------------------------------
TA41886_4081            ------------------------------------------------------------
scaff_XII.704           ------------------------------------------------------------
scaff_XV.507            ------------------------------------------------------------
TA48119_4081            ------------------------------------------------------------
Mt_GASA_                ------------------------------------------------------------
scaff_I.1926            ------------------------------------------------------------
scaff_XIX.758           ------------------------------------------------------------
TA36295_4081            ------------------------------------------------------------
TA95153_4565            ------------------------------------------------------------
TA51752_4565            ------------------------------------------------------------
```

FIGURE 8

```
Os05g0432200          -------------------------------------MASMAKSLLCISLVAILLL----
AK110640              -------------------------------------MASMAKSLLCISLVAILLL----
TA53297_4565          -------------------------------------MAGQARAFMCVALVVLLLL----
TA52915_4565          -------------------------------------MAGKARVFMCVALVVLLLL----
scaff_41.75           -------------------------------------MVSAKTTFILAILCLALMH----
TA52374_4081          -------------------------------------MAISKFLLVTMVLISLLVFRPVE
TA5035_4679           ------------------------------------------------------------
Os09g0414900          ------------------------------WSFREMALAGRLLVLFAIALLAISIA----
GASA6                 -----------------------------------------MAKLITSFLLLTILF----
scaff_XVII.377        -------------------------------------MAK-FVAVFLLALIAISML----
TA56938_4081          -------------------------------------MAK-IVSVLLLALLVISML----
GASA4                 -------------------------------------MAKSYGAIFLLTLIVLFML----
Os05g0376800          --------------------------------MEGVGVGVRIRALLCCIAMAAMLLSSYQ
scaff_VI.397          ------------------------------------------------------------
scaff_I.1483          -------------------------------------MGKSSIAIFLCSLLVLVLLGQNQ
BG128975              ---------------------------------------MAGKMSIVLFVLLVVFLTQNQ
BG130916              ------------------------------------------------------------
TA52635_4081_SEQID2_  -------------------------------------MEKTLSLVLILPLLIMLLLVGTH
TA5923_4679           -------------------------------------MANSTCILLLSLHLLLIIATAIQ
Os06g0266800          ------------------------------------------------------------
TA100367_4565         -----------------------------------MVTKVICFLVLASVLLAVAFPVSAL
CA725087              -------------------------------------MAKISFLLVALLVLAVAFP----
TA77646_4565          -------------------------------------MAKISFLLVALLVLAVAFP----
TA92393_4565          -------------------------------------MAKISFLLVALLVLAVGFP----
CK153563              -------------------------------------MAKISFLFVALLVLAVAFP----
BI208422              ------------------------------------------------------------
TA37180_4081          -------------------------------------MAKSGYNASFLLLIS--------
scaff_II.2328         -------------------------------------MASLSRNS--LLVVL--------
scaff_II.2330         -------------------------------MDPETALELVKQGATLLLLDVPQYTLVGI
GASA5                 -------------------------------------MANCIRRNALFFLTL--------
GASA12                ------------------------------------MMKLIVVFVISSLLFATQFS----
Os10g0115550          -------------------------------------MDPASRSLSIIFFLVAVTF----
TA101332_4565         -------------------------------------MACVARTLSIP-FLLALFF----
TA56201_4081          --------------------------------------MRLLHIFLALLIMAS-------
AJ785329              ------------------------------------------------------------
AK105729              -------------MDTLHNTPTLKLLAWSLGPAFTSTMKLN-----TTTTLALLLL----
Os03g0760800          -------------------------------------MKLN-----TTTTLALLLL----
TA66036_4565          -------------------------------------MKLGP----TATTVALLLV----
BM136027              -------------------------------------MKLGP----TATTVALLLV----
CA705831              -------------------------------------MKKLR----TTTLALLLLL----
CA593033              -------------------------------------MKKLR----TTTLALLLLL----
TA66038_4565          -------------------------------------MKKLRTTTATTTLALILLL----
CD899399              -------------------------------------MKKLHTTTATTTLALLLLL----
Os03g0607200          -------------------------------------MKTRR----AALLMLLLLV----
scaff_IX.735          ------------------------------------------------------------
scaff_I.2410          -----------------------------------MQAPSLF------VFIYLVLE----
Pop_GASA_             -------------------------------------MKKLF------FVTLLLCS----
scaff_40.379          -------------------------------------MKPVF------AAIFLLC-----
TA45751_4081          ------------------------------------------------------------
scaff_205.30          -------------------------------------MKLSF------AALLLLSV----
TA69823_4565          SRNQTRELRCIFTSPQPNKRLLLPNISWTKLKKRRTAMKPLP------VTLALLA-----
TA69821_4565          -------------------------------------MKPLP------VTLALLA-----
Os07g0592000          -----------------------------------MRVPPLR------ATTALLAT----
Os04g0465300          -------------------------------------MAPGKLAVFALLASLLLLN----
scaff_II.204          -------------------------------------MAISKLLIASLLVSLLVLHLAE-
scaff_II.202          -------------------------------------MAISKLLIASLVVSLLVL-----
TA35962_4081          -------------------------------------MAISKALFASLLLSLLLLEQVQS
scaff_II.203          -------------------------------------------MLIWFRFS---------
BE353147              -------------------------------------MTVQKAFVAMLIASFLLVHFANA
TA41886_4081          -------------------------------------MASLKGFAALLIASLVLVHFTYA
scaff_XII.704         ------------------------------------------------------------
scaff_XV.507          ---------------------------------------MAVRSLLALMVFVFCL-----
TA48119_4081          -------------------------------------MAMALRVLLLLVLFFLTVKAQDS
Mt_GASA_              -------------------------------------MERKITLLILMVALLFCMT----
scaff_I.1926          -------------------------------------MAFKAVCLMVVAFVLVTAKASYM
scaff_XIX.758         -------------------------------------MQIT-----FWMQMD--------
TA36295_4081          -------------------------------------MKIFTLFLIFILLIQVFANAATE
TA95153_4565          -----------------------------------MAPGKQ-------LLPPLLLLMLL-
TA51752_4565          -----------------------------------MAPTQQRLLTRRRLLPPLLLLLLLA
```

FIGURE 8 (continued)

```
Os05g0432200          --------------------------VETTAPHGQAY-----------------------
AK110640              --------------------------VETTAPHGQAY-----------------------
TA53297_4565          --------------------------VETTAPSGQAH-----------------------
TA52915_4565          --------------------------VETTAPSGQAH-----------------------
scaff_41.75           -----------------------ELQIRTVEAGKIN------------------------
TA52374_4081          ANGNGDG---------------DNLAVHTAGPEGANNPTYIP------------------
TA5035_4679           -------------------------MLVESAKNGY-------------------------
Os09g0414900          ----------------------EHKALAKGSTSEHDDNVYQV------------------
GASA6                 ----------------------TFVCLTMSKEAEYHPESY--------------------
scaff_XVII.377        ----------------------QTLVVASHGRGGHHNNNKN-------------------
TA56938_4081          ----------------------ANTVMAANGK--HHHYAK--------------------
GASA4                 ----------------------QTMVMASSGS--NVKWSQK-------------------
Os05g0376800          QGQAEASYMPWPPATPPPPAAAAANSTSTAAANNSSSSSSTTAPPQQPTAF---------
scaff_VI.397          --------MSRKPSIN-------ANITEAPTPQPQPNTNSNRPP----------------
scaff_I.1483          -----------------------ALKTPISASQTQRQGNH--------------------
BG128975              VSR--------------------ANIMRDEQQQQQRNNQ---------------------
BG130916              -----------------------MVLVRGRPPSSRLSTK---------------------
TA52635_4081_SEQID2_  ----------------------AKIIIESPAPQPQPPNTLP-------------------
TA5923_4679           VKHAHAP---------------TLQPVNSTAPTAQPNYPS--------------------
Os06g0266800          -----------------------MAGGRGRGGGGGGGVAG--------------------
TA100367_4565         RQQ--------------------VKKGGGGEGGGGGSVSGS-------------------
CA725087              -----------------------VEVMGGGNGGAGGGG----------------------
TA77646_4565          -----------------------VEVMGGGNGGAGGGG----------------------
TA92393_4565          -----------------------VEVMGGGGGGGGGGGG---------------------
CK153563              -----------------------VKVMGVXXXG---------------------------
BI208422              -----------------------MFLILLTFSNVVEGY----------------------
TA37180_4081          -----------------------MFLILLTFSNVVEGY----------------------
scaff_II.2328         -----------------------SLCLLITFSNVAEIHG---------------------
scaff_II.2330         DTQ--------------------VLEIXXXXXXXXXXX----------------------
GASA5                 -----------------------LFLLSVSNLVQAARGG---------------------
GASA12                ----------------------NGDELESQAQAPAIHKNG--------------------
Os10g0115550          -----------------------VVEVSGQKNEAVYHLFG--------------------
TA101332_4565         -----------------------VAEVSGSMNVESYKPAG--------------------
TA56201_4081          --------------------------MSRAQPPVGPTTCP--------------------
AJ785329              ------------------------------------------------------------
AK105729              ------------------------LLLASSSLQVSMAG----------------------
Os03g0760800          ------------------------LLLASSSLQVSMAG----------------------
TA66036_4565          ------------------------LLLASSSLRAATAG----------------------
BM136027              ------------------------LLLASSSLRAATGG----------------------
CA705831              ------------------------VFLAASSLRAAMAG----------------------
CA593033              ------------------------VFLAASSLRAAMAG----------------------
TA66038_4565          ------------------------VLIAATSLRVAMAG----------------------
CD899399              ------------------------VLLAATSLRVAMAG----------------------
Os03g0607200          ------------------------VVAAASWPQPCDAA----------------------
scaff_IX.735          ------------------------------------------------------------
scaff_I.2410          ------------------------ILI----MLVISCG----------------------
Pop_GASA_             ------------------------LLFSSSFLEPVMTK----------------------
scaff_40.379          ------------------------LVFSSSLFEVTMAA----------------------
TA45751_4081          -----------------------------------MAG----------------------
scaff_205.30          ------------------------VLLSSFLRFTMAVPNHVA------------------
TA69823_4565          ------------------------LFLAASYQDLAVAA-ADA------------------
TA69821_4565          ------------------------LFLVASYQDLTVAADADA------------------
Os07g0592000          ------------------------LLVAASFQDLTVAA----------------------
Os04g0465300          ------------------------TIKAADYPPAPPLGPPP-------------------
scaff_II.204          ----------------------ADQKVNSNQAASHVPG-N--------------------
scaff_II.202          ------------------------QQVNASPAAGSIPG-K--------------------
TA35962_4081          I---------------------QTDQVSSNAISEGADSYK--------------------
scaff_II.203          ------------------------------------------------------------
BE353147              -----------------------QKVDYSKPPASAPQGPQ--------------------
TA41886_4081          L----------------------QEVISGKPPAPSPQPPK--------------------
scaff_XII.704         ------------------------------------------------------------
scaff_XV.507          -------------------------------AELVVRGGN--------------------
TA48119_4081          IIDL-----------KEVEEDKQQHVGLSQALRVFTRGAN--------------------
Mt_GASA_              ---------------KVLCADSSVHIQDQFTHFEVVKGPN--------------------
scaff_I.1926          NEDF-----------KEKAVFSKSVVPASTPAPPEVKSPTPAPPVVTPSTPLYKPPTPAP
scaff_XIX.758         --------------------------EESDVVAIDKKHYP--------------------
TA36295_4081          Q------------------------IEAGNEGALHKKIHPI-------------------
TA95153_4565          -HHQPAAG---ASDPPVT----HGGMRASTARSLLQQQQQ--------------------
TA51752_4565          AHLQPAAASSSASDPLVTTTTAHGSMRAS-SRSLLQQQ----------------------
```

FIGURE 8 (continued)

```
Os05g0432200          ------------------------------------------------------------
AK110640              ------------------------------------------------------------
TA53297_4565          ------------------------------------------------------------
TA52915_4565          ------------------------------------------------------------
scaff_41.75           ------------------------------------------------------------
TA52374_4081          ------------------------------------------------------------
TA5035_4679           ------------------------------------------------------------
Os09g0414900          ------------------------------------------------------------
GASA6                 ------------------------------------------------------------
scaff_XVII.377        ------------------------------------------------------------
TA56938_4081          ------------------------------------------------------------
GASA4                 ------------------------------------------------------------
Os05g0376800          ------------------------------------------------------------
scaff_VI.397          ------------------------------------------------------------
scaff_I.1483          ------------------------------------------------------------
BG128975              ------------------------------------------------------------
BG130916              ------------------------------------------------------------
TA52635_4081_SEQID2_  ------------------------------------------------------------
TA5923_4679           ------------------------------------------------------------
Os06g0266800          ------------------------------------------------------------
TA100367_4565         ------------------------------------------------------------
CA725087              ------------------------------------------------------------
TA77646_4565          ------------------------------------------------------------
TA92393_4565          ------------------------------------------------------------
CK153563              ------------------------------------------------------------
BI208422              ------------------------------------------------------------
TA37180_4081          ------------------------------------------------------------
scaff_II.2328         ------------------------------------------------------------
scaff_II.2330         ------------------------------------------------------------
GASA5                 ------------------------------------------------------------
GASA12                ------------------------------------------------------------
Os10g0115550          ------------------------------------------------------------
TA101332_4565         ------------------------------------------------------------
TA56201_4081          ------------------------------------------------------------
AJ785329              ------------------------------------------------------------
AK105729              ------------------------------------------------------------
Os03g0760800          ------------------------------------------------------------
TA66036_4565          ------------------------------------------------------------
BM136027              ------------------------------------------------------------
CA705831              ------------------------------------------------------------
CA593033              ------------------------------------------------------------
TA66038_4565          ------------------------------------------------------------
CD899399              ------------------------------------------------------------
Os03g0607200          ------------------------------------------------------------
scaff_IX.735          ------------------------------------------------------------
scaff_I.2410          ------------------------------------------------------------
Pop_GASA_             ------------------------------------------------------------
scaff_40.379          ------------------------------------------------------------
TA45751_4081          ------------------------------------------------------------
scaff_205.30          ------------------------------------------------------------
TA69823_4565          ------------------------------------------------------------
TA69821_4565          ------------------------------------------------------------
Os07g0592000          ------------------------------------------------------------
Os04g0465300          ------------------------------------------------------------
scaff_II.204          ------------------------------------------------------------
scaff_II.202          ------------------------------------------------------------
TA35962_4081          ------------------------------------------------------------
scaff_II.203          ------------------------------------------------------------
BE353147              ------------------------------------------------------------
TA41886_4081          ------------------------------------------------------------
scaff_XII.704         ------------------------------------------------------------
scaff_XV.507          ------------------------------------------------------------
TA48119_4081          ------------------------------------------------------------
Mt_GASA_              ------------------------------------------------------------
scaff_I.1926          PVKTPPPAPPVNPPTPVKPPTTPAPPVYKPPSPAPPVNPPTPVKPPTTPAPPVYKPPSPA
scaff_XIX.758         ------------------------------------------------------------
TA36295_4081          ------------------------------------------------------------
TA95153_4565          ------------------------------------------------------------
TA51752_4565          ------------------------------------------------------------
```

FIGURE 8 (continued)

```
Os05g0432200              --------------------------------------------------AIDCGAKCGY
AK110640                  --------------------------------------------------AIDCGAKCGY
TA53297_4565              --------------------------------------------------AVDCGSACSY
TA52915_4565              --------------------------------------------------AVDCGSACSY
scaff_41.75               -----------------------------------------------------CKSKCEY
TA52374_4081              --------------------------------------------------TSECGTACEA
TA5035_4679               -------------------------------------GQGSLRS-------YQCSGQCAR
Os09g0414900              ----------------------------------SKGGQGSLKS-------YQCSPQCAY
GASA6                     -------------------------------------GPGSLKS-------YQCGGQCTR
scaff_XVII.377            -----------------------------------KYGPGSLKS-------FQCPSQCTR
TA56938_4081              -----------------------------------KYGPGSLKP-------SQCLPQCTR
GASA4                     -----------------------------------RYGPGSLKR-------TQCPSECDR
Os05g0376800              --------------------------------PMYGVTPGSLRP-------QECGGRCAY
scaff_VI.397              ----------------------------------YGTTQGSLNP-------QECGPRCTG
scaff_I.1483              --------------------------------AMYGATQGSLRP-------QECAPRCTT
BG128975                  ---------------------------------LYGVSEGRLHP-------QDCQPKCTY
BG130916                  ---------------------------------MHRT-----------------------
TA52635_4081_SEQID2_      ---------------------------------MNGTTPGSLHP-------QDCLPKCTY
TA5923_4679               ----------------------------------HGFTEGSLQP-------QECGGRCDV
Os06g0266800              --------------------------------------GGNLRP-------WECSPKCAG
TA100367_4565             -------------------------------------GGGNLNP-------WECSPKCGS
CA725087                  ----------------------------------------KLKP-------WECSSKCSS
TA77646_4565              ----------------------------------------KLKP-------WECSSKCSS
TA92393_4565              ----------------------------------------NLKP-------WECSSKCSS
CK153563                  ----------------------------------------KLKP-------WECPSKCSS
BI208422                  ---------------------------------------NKLRP-------TDCKPRCTY
TA37180_4081              ---------------------------------------NKLRP-------TDCKPRCTY
scaff_II.2328             ---------------------------------------AKLRP-------SECKPRCNY
scaff_II.2330             ---------------------------------------XXXXXXEATSLISPASTRCNY
GASA5                     ---------------------------------------GKLKP-------QQCNSKCSF
GASA12                    -------------------------------------GEGSLKP-------EECPKACEY
Os10g0115550              -------------------------------------GEGSLTK-------NECPGKCSY
TA101332_4565             -------------------------------------AEGSVPL-------KECPAKCKI
TA56201_4081              -----------------------------------------VPK-------DKCEEACNV
AJ785329                  ---------------------------------------------------------MDI
AK105729                  --------------------------------------------------SDFCDGKCKV
Os03g0760800              --------------------------------------------------SDFCDGKCKV
TA66036_4565              --------------------------------------------------SAFCDGKCGV
BM136027                  --------------------------------------------------SAFCDGKCGV
CA705831                  --------------------------------------------------SAFCDGKCGV
CA593033                  --------------------------------------------------SAFCDGKCGV
TA66038_4565              --------------------------------------------------SAFCDSKCGV
CD899399                  --------------------------------------------------SAFCDSKCGV
Os03g0607200              --------------------------------------------------SGFCGSKCAV
scaff_IX.735              ------------------------------------------------------------
scaff_I.2410              --------------------------------------------------VAFCTKKCNT
Pop_GASA_                 --------------------------------------------------SSFCAKKCDT
scaff_40.379              --------------------------------------------------SGFCDSKCSV
TA45751_4081              --------------------------------------------------SYFCDSKCKL
scaff_205.30              ------------------------------------SPPPPS-----PAIPSFCDPKCKA
TA69823_4565              ------------------------------------DADGVG--SGAPVLDSVCEGKCKN
TA69821_4565              ------------------------------------DAAGAGDVGAVPVPDSVCEGKCKN
Os07g0592000              --------------------------------------DGGG--GVVPVPDSVCDAKCQK
Os04g0465300              --------------------------------------HKIVDP------GKDCVGACDA
scaff_II.204              --------------------------------------------------NIDCGGACHA
scaff_II.202              --------------------------------------------------NIDCGGACKD
TA35962_4081              --------------------------------------------------KIDCGGACAA
scaff_II.203              ----------------------------------------------------DCGSACKA
BE353147                  --------------------------------------------------PLDCIGACKY
TA41886_4081              --------------------------------------------------PIDCTGSCKT
scaff_XII.704             --------MDSIRY----------------------------------------CGGLCKQ
scaff_XV.507              -----RRLMQDID-----------------------------------------CGGLCKQ
TA48119_4081              -----RRLVQDIVLKVAKYLNNGDI--------------ALAPAPAPPPSPLDCGGLCKY
Mt_GASA_                  -----RRLLAFVD----------------------------------------CGTRCNV
scaff_I.1926              PPVNPPTPVPPVKPPTAPAPPVYKPPSPAPTPVPPVKPPTTGPMPPPVRTRSDCTPLCGQ
scaff_XIX.758             -------------------------------------------------KRINCGYLCAR
TA36295_4081              -------------------------------------------------KRIHCGYACAR
TA95153_4565              -----------------------------------------------QPPRLDCPKVCLG
TA51752_4565              -----------------------------------------------PPPRLDCPKVCLG
```

FIGURE 8 (continued)

| | |
|---|---|
| Os05g0432200 | RCSKSG-RPKMCLRACGTCCQRCG-CVPPGTSG-NENVCP-CYANMTTHNGRH------- |
| AK110640 | RCSKSG-RPKMCLRACGTCCQCCG-CVPPGTSG-NENVCP-CYANMTTHNGRH------- |
| TA53297_4565 | RCSKSS-RPNLCNRACNTCCRRCD-CVPPGTAG-NEDVCP-CYAHMTTHDGRH------- |
| TA52915_4565 | RCSKSS-RPNLCNRACNTCCRRCD-CVPPGTAG-NEDVCP-CYAHMTTHDGRH------- |
| scaff_41.75 | RCSKAS-RHKMCIRACNTCCQRCN-CVPPGTSG-NEDTCP-CYANMTTHGGRH------- |
| TA52374_4081 | RCSLAS-RHKMCLRACGTCCTRCN-CVPPGTSG-NQDLCP-CYRDMLTHHGKH------- |
| TA5035_4679 | RCSKTQ-YRKPCLFFCNKCCAKCL-CVPPGFYG-NKGVCP-CYNNWKTQ-QGGP------ |
| Os09g0414900 | RCSQTQ-YKKPCLFFCNKCCNACL-CVPSGLYG-NKGECP-CYNNWKTK-RGGP------ |
| GASA6 | RCSNTK-YHKPCMFFCQKCCAKCL-CVPPGTYG-NKQVCP-CYNNWKTQ-QGGP------ |
| scaff_XVII.377 | RCSKTQ-YHKPCMFFCQKCCKKCL-CVPPGYYG-NKAVCP-CYNNWKTK-EGGP------ |
| TA56938_4081 | RCSKTQ-YHKPCMFFCQKCCNKCL-CVPPGTYG-NKAVCP-CYNNWKTK-EGGP------ |
| GASA4 | RCKKTQ-YHKACITFCNKCCRKCL-CVPPGYYG-NKQVCS-CYNNWKTQ-EGGP------ |
| Os05g0376800 | RCSATA-YRKPCMFFCQKCCASCL-CVLPGTYG-NKQSCP-CYNDWKTK-RGGP------ |
| scaff_VI.397 | RCSKTA-FKKPCMFFCQKCCAKCL-CVPAGTYG-NKQSCP-CYNNWKTK-RGGP------ |
| scaff_I.1483 | RCSATA-YKKPCLFFCQKCCAKCL-CVPPGTYG-NKQSCP-CYNNWKTK-RGGP------ |
| BG128975 | RCSKTS-YKKPCMFFCQKCCAKCL-CVPAGTYG-NKQSCP-CYNNWKTK-RGGP------ |
| BG130916 | RCSKTS-YKKPCMFFCQKCCAKCL-CVPAGTYG-NKQSCP-CYNNWKTK-RGGP------ |
| TA52635_4081_SEQID2_ | RCSNTQ-YRKPCMFFCQKCCAKCL-CVPAGTYG-NKQFCP-CYNNWKTK-RGGP------ |
| TA5923_4679 | RCSATQ-YRKPCMFFCQKCCATCR-CVPSGTYG-NKQTCP-CYNNWKTK-RGGP------ |
| Os06g0266800 | RCSNTQ-YKKACLTFCNKCCAKCL-CVPPGTYG-NKGACP-CYNNWKTK-EGGP------ |
| TA100367_4565 | RCSKTQ-YRKACLTLCNKCCAKCL-CVPPGFYG-NKGACP-CYNNWENK-EGGP------ |
| CA725087 | RCSGTQ-YKKACLTYCXKCCATCL-CVPPGNYG-NKGAWP-CYNNWEEQXREGP------ |
| TA77646_4565 | RCSGTQ-YKKACLTYCNKCCATCL-CVPPGTYG-NKGACP-CYNNWKTK-EGGP------ |
| TA92393_4565 | RCSGTQ-YKKACLTYCNKCCATCL-CVPPGTYG-NKGACP-CYNNWKTK-EGGP------ |
| CK153563 | RCSGTQ-YKKACLTYCNKCCATCL-CVPPGTYG-NKGACP-CYNNWKTK-EGGP------ |
| BI208422 | RCSATS-HKKPCMFFCQKCCATCL-CVPKGVYG-NKQSCP-CYNNWKTQ-EGKP------ |
| TA37180_4081 | RCSATS-HKKPCMFFCQKCCATCL-CVPKGVYG-NKQSCP-CYNNWKTQ-EGKP------ |
| scaff_II.2328 | RCSATS-HKKPCMFFCLKCCATCL-CVPPGTYG-NKETCP-CYNNWKTK-EGRP------ |
| scaff_II.2330 | RCSATS-HKKPCMFFCLKCCATCL-CVPPGTYG-NKETCP-CYNNWKTK-EGRP------ |
| GASA5 | RCSATS-HKKPCMFFCLKCCKKCL-CVPPGTFG-NKQTCP-CYNNWKTK-EGRP------ |
| GASA12 | RCSATS-HRKPCLFFCNKCCNKCL-CVPSGTYG-HKEECP-CYNNWTTK-EGGP------ |
| Os10g0115550 | RCSATS-HTTVCMTYCNYCCERCL-CVPSGTYG-NKEECP-CYNNMKTQ-EGKPN----- |
| TA101332_4565 | RCSATS-HKKPCNFYCNYCCKRCL-CVPSGTVG-NKEECP-CYNNLKTQ-DGKP------ |
| TA56201_4081 | RCSQKG-HKKRCLFYCNHCCGWCQ-CVPPGYVGENKDCCP-CYRDWKKQ-TGEP------ |
| AJ785329 | NGSHKG-HKKRCLFYCNHCCGWCQ-CVPPGYVGQNKGCCS-CYNNWKTQ-IGGP------ |
| AK105729 | RCSKAS-RHDDCLKYCGVCCASCN-CVPSGTAG-NKDECP-CYRDMTTG-HGARK----- |
| Os03g0760800 | RCSKAS-RHDDCLKYCGVCCASCN-CVPSGTAG-NKDECP-CYRDMTTG-HGARK----- |
| TA66036_4565 | RCSKAS-RHDDCLKYCGICCAECN-CVPSGTAG-NKDECP-CYRDKTTG-HGARK----- |
| BM136027 | RCSKAS-RHDDCLKYCGICCAECN-CVPSGTAG-NKDECP-CYRDKTTG-HGARK----- |
| CA705831 | RCSKAS-RHDDCLKYCGICCAECN-CVPSGTAG-NKDECP-CYRXKNNG-QGARKEGQVP |
| CA593033 | RCSKAG-RHDDCLKYCGICCAECN-CVPSGTAG-NKDECP-CYRDKNNG-HGARKEGQMP |
| TA66038_4565 | RCSKTG-RHDDCLKYCGICCAECN-CVPSGTAG-NKDECP-CYRDKTTG-HGART----- |
| CD899399 | RCSKAS-RHDDCLKYCGICCAECN-CVPSGTAG-NKDECP-CYRDKTTG-HGART----- |
| Os03g0607200 | RCGRGRGRGSGCLRSCGLCCEECN-CVPTGSGS-TRDECP-CYRDMLT--AGPRK----- |
| scaff_IX.735 | --------------YCGICCEQCK-CVPSGTYG-NKHECP-CYRDKRNS-KG-------- |
| scaff_I.2410 | RCANAG-IQDRCLKYCGICCEQCK-CVPSGTYG-NKHECP-CYRDKRNS-KG-------- |
| Pop_GASA_ | RCANAG-IQDRCLKYCGICCEQCK-CVPSGTYG-NKHECP-CYRDKRNS-KG-------- |
| scaff_40.379 | RCSKAG-IKDRCLKYCGICCEKCK-CVPSGTYG-NKHECP-CYRDMKNS-KG-------- |
| TA45751_4081 | RCSKAG-LADRCLKYCGICCEECK-CVPSGTYG-NKHECP-CYRDKKNS-KG-------- |
| scaff_205.30 | RCAKAG-YYQRCYDYCIICCKDCK-CVPSGTYG-NKSECP-CYRDKLNS-KG-------- |
| TA69823_4565 | RCSQKV--AGRCMGLCMMCCGKCAGCVPSGPLA-PKDECP-CYRDMKSP-KSG------- |
| TA69821_4565 | RCSQKV--AGRCMGLCMMCCGKCAGCVPSGPLA-PKDECP-CYRDMKSP-KSG------- |
| Os07g0592000 | RCSLKV--AGRCMGLCKMCCHDCGGCVPSGPYA-SKDECP-CYRDMVSP-KSR------- |
| Os04g0465300 | RCSEHS-HKKRCSRSCLTCCSACR-CVPAGTAG-NRETCGRCYTDWVSHNNMT------- |
| scaff_II.204 | RCSLSS-RPRLCKRACGSCCARCK-CVPQGTSG-NLDTCP-CYATLTTRGGRR------- |
| scaff_II.202 | RCSLSS-RPHLCNRACGTCCARCK-CVPKGTSG-NLDTCP-CYATMTTHGGRR------- |
| TA35962_4081 | RCRLSS-RPRLCHRACGTCCARCN-CVPPGTSG-NTETCP-CYASLTTHGNKR------- |
| scaff_II.203 | RCQLSS-RPRLCKRACGTCCSRCS-CVPPGTAG-NYEACP-CYASLTTHGGRR------- |
| BE353147 | RCSESS-RQNLCNRACGSCCHRCH-CVPPGTSG-NYESCP-CYFNLTTHNTTR------- |
| TA41886_4081 | RCSKSS-RQNLCNRACGSCCRTCH-CVPPGTSG-NYEACP-CYFNLTTHNSTR------- |
| scaff_XII.704 | RCSLHS-RPNLCNRACGTCCVRCK-CVPPGTSG-NREVCGTCYTDMTTHGNKT------- |
| scaff_XV.507 | RCSLHS-RPNVCTRACGTCCVRCK-CVPPGTSG-NREVCGTCYTDMTTHGNKT------- |
| TA48119_4081 | RCSLHS-RPNVCFRACGTCCVRCK-CVPPGTFG-NREKCGKCYTEMTTHGNKT------- |
| Mt_GASA_ | RCSVHS-RPNVCMRACGTCCLRCK-CVPPGTYG-NREMCGRCYTDMITRGNKP------- |
| scaff_I.1926 | RCKLHS-RKRLCVRACMTCCDRCK-CVPPGTYG-NREKCGKCYTDMTTRRNKP------- |
| scaff_XIX.758 | RCRASS-RKNVCHRACKTCCNRCR-CVPPGTYG-NKSACP-CYASLRTHGNKP------- |
| TA36295_4081 | RCKKSS-RKKVCMRACKTCCARCK-CVPPGTYG-NKEVCP-CYARLRTHGNKP------- |
| TA95153_4565 | RCANNW-RNEMCNDKCNVCCQRCN-CVPPGTGQDTRHICP-CYDRMTNPHNGKL------ |
| TA51752_4565 | RCANNW-KNEMCNDKCNVCCQRCN-CVPPGTGQDTRHICP-CYDQMTNPHNGKL------ |
| | * ** * ** * ** |

FIGURE 8 (continued)

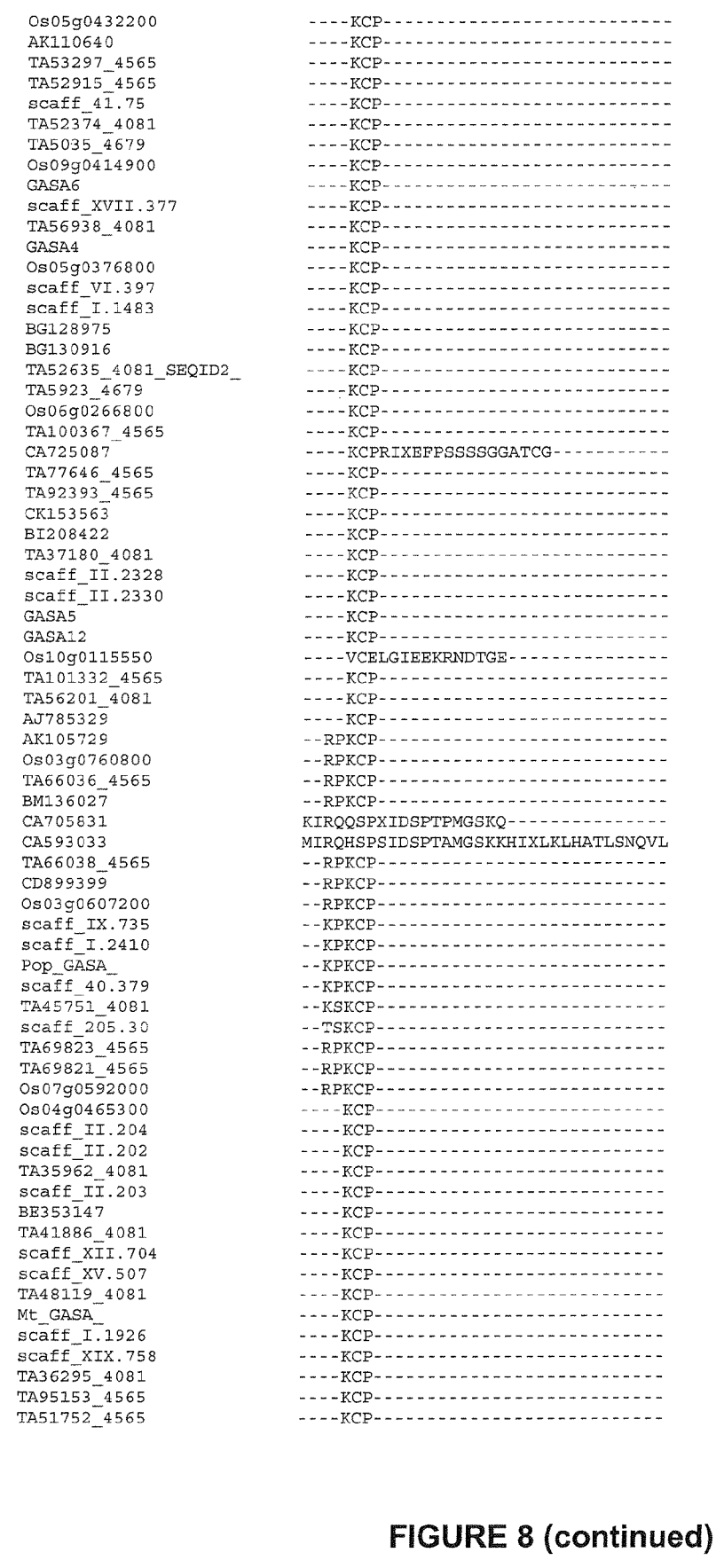

```
Os05g0432200            ----KCP--------------------------
AK110640                ----KCP--------------------------
TA53297_4565            ----KCP--------------------------
TA52915_4565            ----KCP--------------------------
scaff_41.75             ----KCP--------------------------
TA52374_4081            ----KCP--------------------------
TA5035_4679             ----KCP--------------------------
Os09g0414900            ----KCP--------------------------
GASA6                   ----KCP--------------------------
scaff_XVII.377          ----KCP--------------------------
TA56938_4081            ----KCP--------------------------
GASA4                   ----KCP--------------------------
Os05g0376800            ----KCP--------------------------
scaff_VI.397            ----KCP--------------------------
scaff_I.1483            ----KCP--------------------------
BG128975                ----KCP--------------------------
BG130916                ----KCP--------------------------
TA52635_4081_SEQID2_    ----KCP--------------------------
TA5923_4679             ----KCP--------------------------
Os06g0266800            ----KCP--------------------------
TA100367_4565           ----KCP--------------------------
CA725087                ----KCPRIXEFPSSSSGGATCG----------
TA77646_4565            ----KCP--------------------------
TA92393_4565            ----KCP--------------------------
CK153563                ----KCP--------------------------
BI208422                ----KCP--------------------------
TA37180_4081            ----KCP--------------------------
scaff_II.2328           ----KCP--------------------------
scaff_II.2330           ----KCP--------------------------
GASA5                   ----KCP--------------------------
GASA12                  ----KCP--------------------------
Os10g0115550            ----VCELGIEEKRNDTGE--------------
TA101332_4565           ----KCP--------------------------
TA56201_4081            ----KCP--------------------------
AJ785329                ----KCP--------------------------
AK105729                --RPKCP--------------------------
Os03g0760800            --RPKCP--------------------------
TA66036_4565            --RPKCP--------------------------
BM136027                --RPKCP--------------------------
CA705831                KIRQQSPXIDSPTPMGSKQ--------------
CA593033                MIRQHSPSIDSPTAMGSKKHIXLKLHATLSNQVL
TA66038_4565            --RPKCP--------------------------
CD899399                --RPKCP--------------------------
Os03g0607200            --RPKCP--------------------------
scaff_IX.735            --KPKCP--------------------------
scaff_I.2410            --KPKCP--------------------------
Pop_GASA_               --KPKCP--------------------------
scaff_40.379            --KPKCP--------------------------
TA45751_4081            --KSKCP--------------------------
scaff_205.30            --TSKCP--------------------------
TA69823_4565            --RPKCP--------------------------
TA69821_4565            --RPKCP--------------------------
Os07g0592000            --RPKCP--------------------------
Os04g0465300            ----KCP--------------------------
scaff_II.204            ----KCP--------------------------
scaff_II.202            ----KCP--------------------------
TA35962_4081            ----KCP--------------------------
scaff_II.203            ----KCP--------------------------
BE353147                ----KCP--------------------------
TA41886_4081            ----KCP--------------------------
scaff_XII.704           ----KCP--------------------------
scaff_XV.507            ----KCP--------------------------
TA48119_4081            ----KCP--------------------------
Mt_GASA_                ----KCP--------------------------
scaff_I.1926            ----KCP--------------------------
scaff_XIX.758           ----KCP--------------------------
TA36295_4081            ----KCP--------------------------
TA95153_4565            ----KCP--------------------------
TA51752_4565            ----KCP--------------------------
```

FIGURE 8 (continued)

```
                                            1                                                50
       seqidno02,PRT,Oryzasativa>  (1)  --------------------------------------------------
seqidno2,PRT,Arabidopsisthaliana>  (1)  --------------------------------------------------
seqidno14,PRT,Arabidopsisthaliana> (1)  --------------------------------------------------
seqidno24,PRT,Arabidopsisthaliana> (1)  --------------------------------------------------
          seqidno228,PRT,Zeamays>  (1)  --------------------------------------------------
       seqidno84,PRT,Oryzasativa>  (1)  --------------------------------------------------
      seqidno102,PRT,Oryzasativa>  (1)  --------------------------------------------------
      seqidno108,PRT,Oryzasativa>  (1)  --------------------------------------------------
      seqidno126,PRT,Oryzasativa>  (1)  --------------------------------------------------
      seqidno180,PRT,Oryzasativa>  (1)  --------------------------------------------------
seqidno22,PRT,Arabidopsisthaliana> (1)  --------------------------------------------------
seqidno54,PRT,Arabidopsisthaliana> (1)  --------------------------------------------------
      seqidno120,PRT,Oryzasativa>  (1)  --------------------------MAPPQER-DYIGLSP---------
      seqidno144,PRT,Oryzasativa>  (1)  --------------------------MSPPLEL-DYIGLSPPPPP--PSS
       seqidno72,PRT,Oryzasativa>  (1)  --------------------------MSPPLEL-DYIGLSPPPPP--PSS
          seqidno210,PRT,Zeamays>  (1)  --------------------------MSPPLDL-DYIGLSP---------
      seqidno174,PRT,Oryzasativa>  (1)  --------------------------MPPPLEARDYIGLGATPAS--SSS
          seqidno198,PRT,Zeamays>  (1)  --------------------------------------------------
      seqidno138,PRT,Oryzasativa>  (1)  --------------------------------------------------
      seqidno192,PRT,Oryzasativa>  (1)  --------------------------------------------------
          seqidno234,PRT,Zeamays>  (1)  --------------------------------------------------
      seqidno156,PRT,Oryzasativa>  (1)  --------------------------------------------------
       seqidno90,PRT,Oryzasativa>  (1)  --------------------------------------------------
      seqidno162,PRT,Oryzasativa>  (1)  --------------------------------------------------
          seqidno216,PRT,Zeamays>  (1)  --------------------------------------------------
seqidno36,PRT,Arabidopsisthaliana> (1)  --------------------------------------------------
seqidno48,PRT,Arabidopsisthaliana> (1)  --------------------------------------------------
seqidno66,PRT,Arabidopsisthaliana> (1)  MSPEEELQSNVSVASSSPTSNCISRNTLGGLKEHNYLGLSDCSSVGSSTL
                        Consensus  (1)

                                            51                                              100
       seqidno02,PRT,Oryzasativa>  (1)  --------------------------------------------------
seqidno2,PRT,Arabidopsisthaliana>  (1)  --------------------------------------------------
seqidno14,PRT,Arabidopsisthaliana> (1)  ----------------------------------------------MYCS
seqidno24,PRT,Arabidopsisthaliana> (1)  --------------------------------------------------
          seqidno228,PRT,Zeamays>  (1)  --------------------------------------------------
       seqidno84,PRT,Oryzasativa>  (1)  --------------------------------------------------
      seqidno102,PRT,Oryzasativa>  (1)  --------------------------------------------------
      seqidno108,PRT,Oryzasativa>  (1)  --------------------------------------------------
      seqidno126,PRT,Oryzasativa>  (1)  --------------------------------------------------
      seqidno180,PRT,Oryzasativa>  (1)  --------------------------------------------------
seqidno22,PRT,Arabidopsisthaliana> (1)  --------------------------------------------------
seqidno54,PRT,Arabidopsisthaliana> (1)  --------------------------------------------------
      seqidno120,PRT,Oryzasativa> (15)  --------AAAAALATELRLGLPGTAEEAESEGGGGG-------------
      seqidno144,PRT,Oryzasativa> (22)  SSAAAARADDVDLKGTELRLGLPGSESPDRHPAAIA--------------
       seqidno72,PRT,Oryzasativa> (22)  SSAAAARADDVDLKGTELRLGLPGSESPDRRPAAIA--------------
          seqidno210,PRT,Zeamays> (15)  --AAAAAAAHDDLKGTELRLGLPGSGSPDRR-------------------
      seqidno174,PRT,Oryzasativa> (23)  SCCASTPVAEVVGAHLALRLGLPGSESPARAEAEAVV-------------
          seqidno198,PRT,Zeamays>  (1)  --------------------------------------------------
      seqidno138,PRT,Oryzasativa>  (1)  ------MAADLAFEATELRLGLPGGGGDGDA-------------------
      seqidno192,PRT,Oryzasativa>  (1)  ------MAADLAFEATELRLGLPGGGGGDGDA------------------
          seqidno234,PRT,Zeamays>  (1)  ----MATTTDLGFEATELRLGLPGGGGGGGEP------------------
      seqidno156,PRT,Oryzasativa>  (1)  --------------------------------------------------
       seqidno90,PRT,Oryzasativa>  (1)  -------MAGLGFDETELRLGLPGAG------------------------
      seqidno162,PRT,Oryzasativa>  (1)  ------MAGADVDVGTELRLGLPGGGG-G---------------------
          seqidno216,PRT,Zeamays>  (1)  ------MAGADVDVGTELRLGLPGGG------------------------
seqidno36,PRT,Arabidopsisthaliana> (1)  ---------MINFEATELRLGLPGGN------------------------
seqidno48,PRT,Arabidopsisthaliana> (1)  -----MIGQLMNLKATELCLGLPGGA------------------------
seqidno66,PRT,Arabidopsisthaliana> (51) SPLAEDDKATISLKATELTLGLPGSQSPARDTELNLLSPAKLDEKPFFPL
                        Consensus (51)                    L LGLPG
```

FIGURE 11

```
                                          101                                              150
          seqidno02,PRT,Oryzasativa>   (1) --------------------------------MEEEKRLELRLAPPCHQF
     seqidno2,PRT,Arabidopsisthaliana>   (1) --------------------------------MEEEKRLELRLAPPCHQF
    seqidno14,PRT,Arabidopsisthaliana>   (5) DPPHPLHLVASDKQQKDHKLILSWKKPTMDSDPLGVFPNSPKYHPYYSQT
    seqidno24,PRT,Arabidopsisthaliana>   (1) ---------------------------MDPNTPADFFKGSSKFHTYYSQT
              seqidno228,PRT,Zeamays>   (1) --------------MRETRTESYSASINKAPTEKKQESTTSGCRLFGIEI
          seqidno84,PRT,Oryzasativa>   (1) --------------------MELELGLAPPNSGHLVVDELSSSSSSGGGS
         seqidno102,PRT,Oryzasativa>   (1) ----------------MSVETERSSTESSAASGLDFEDTALTLRLPGSSS
         seqidno108,PRT,Oryzasativa>   (1) --------------------------------------------------
         seqidno126,PRT,Oryzasativa>   (1) ------------------MSTSSGADSSPPVSGLDYDDTALTLALPGSSS
         seqidno180,PRT,Oryzasativa>   (1) ------------------MSTSSGADSSPPVSGLDYDDTALTLALPGSSS
    seqidno22,PRT,Arabidopsisthaliana>   (1) --------------------MSPEEYVRVWPDSGDLGGTELTLALPGTPT
    seqidno54,PRT,Arabidopsisthaliana>   (1) ---------------------------MEVTNGLNLKDTELRLGLPGAQ-
         seqidno120,PRT,Oryzasativa>  (44) ----------------GTDAAPLTLELLPKGGAKRGFADAIVGGPAGQRR
         seqidno144,PRT,Oryzasativa>  (58) ----------------AAAATATTLELLPAKGAKRVFPDEAALTPPT---
          seqidno72,PRT,Oryzasativa>  (58) ----------------AAAATATTLELLPAKGAKRVFPDEAALTPPT---
              seqidno210,PRT,Zeamays>  (44) ----------------VVAATATTLDLLPAKGAKRGFSDEAPTPSPG---
         seqidno174,PRT,Oryzasativa>  (60) ----------------VDAALTLGPAPPPRGGAKRGFVDSLDRSEGR-RA
              seqidno198,PRT,Zeamays>   (1) --------------------------------------------------
         seqidno138,PRT,Oryzasativa>  (26) --------------A-----AAAAR----SSSGKRGFAETIDLKLKLEPA
         seqidno192,PRT,Oryzasativa>  (26) --------------A-----AAAAR----SSSGKRGFAETIDLKLKLEPA
              seqidno234,PRT,Zeamays>  (28) --------------A-----LGGEGRSSSSASGKRGFAETIDLKLKLEPA
         seqidno156,PRT,Oryzasativa>   (1) --------------------------------------------------
          seqidno90,PRT,Oryzasativa>  (20) --------------E-----LAARS------SGKRGFAETIDLKLKLQPA
         seqidno162,PRT,Oryzasativa>  (23) ------------------------AAEAAAKAAKRGFEETIDLKLKLPTA
              seqidno216,PRT,Zeamays>  (21) --------------------------ADAAKAAKRGFEDTIDLKLKLPTA
    seqidno36,PRT,Arabidopsisthaliana>  (18) --------------------HGGEMAGKNNG--KRGFSETVDLKLNLSST
    seqidno48,PRT,Arabidopsisthaliana>  (22) --------------------EAVESPAKSAVGSKRGFSETVDLMLNLQSN
    seqidno66,PRT,Arabidopsisthaliana> (101) LPSKDEICSSSQKNNASGNKRGFSDTMDQFAEAKSSVYTEKNWMFPEAA-
                           Consensus (101)                                 GKR F E L L L

                                          151                                              200
          seqidno02,PRT,Oryzasativa>  (19) TS-------------------------------------------NNNIN
     seqidno2,PRT,Arabidopsisthaliana>  (19) TS-------------------------------------------NNNIN
    seqidno14,PRT,Arabidopsisthaliana>  (55) TEFGG--------------------------------------VIDLGLS
    seqidno24,PRT,Arabidopsisthaliana>  (24) KKGGG--------------------------------------VIDLGLS
              seqidno228,PRT,Zeamays>  (37) G-------------------------------------------SSAVSP
          seqidno84,PRT,Oryzasativa>  (31) GS-------APVSASSAGKRG---------------------FREAFQET
         seqidno102,PRT,Oryzasativa>  (35) SSSSSS------SSSSSSS--------------------PSEPDRKRASA
         seqidno108,PRT,Oryzasativa>   (1) --------------------------------------------------
         seqidno126,PRT,Oryzasativa>  (33) SSSS-----------------------------------TADPERKRAAH
         seqidno180,PRT,Oryzasativa>  (33) SSSSS----------------------------------TADPERKRAAH
    seqidno22,PRT,Arabidopsisthaliana>  (31) NAS---------EGPKKFG------------------------NKRRFLE
    seqidno54,PRT,Arabidopsisthaliana>  (23) ---------------EEQQLE------------------------LSCVR
         seqidno120,PRT,Oryzasativa>  (78) E-------------AAGGK---------------------------AAAA
         seqidno144,PRT,Oryzasativa>  (89) --------------AAAGKGK------------------------AAREG
          seqidno72,PRT,Oryzasativa>  (89) --------------AAAGKGK------------------------AAREG
              seqidno210,PRT,Zeamays>  (75) --------------AASGK------------------------------G
         seqidno174,PRT,Oryzasativa>  (93) A-------------ATAGDDE------------------------RGVRE
              seqidno198,PRT,Zeamays>   (1) --------------------------------------------------
         seqidno138,PRT,Oryzasativa>  (53) AAAVDDDDDKEEAAADDREKKVDIVGADNDDASPPAAAAAGGMKRSPSQS
         seqidno192,PRT,Oryzasativa>  (53) AAAVDDDDDKEEAAADDREKKVDIVGADNDDASPPAAAAAGGMKRSPSQS
              seqidno234,PRT,Zeamays>  (59) AVVEAEEEEEDHGVAVALEK---------------EEE-AGKMKRSPSQS
         seqidno156,PRT,Oryzasativa>   (1) --------------------------------------------------
          seqidno90,PRT,Oryzasativa>  (45) APAAVSGEEGAQEDKEDADA------------AAAAADEKMSMKRSASQS
         seqidno162,PRT,Oryzasativa>  (49) G--------MEEA--AAGKAEAP----------------------AAEKA
              seqidno216,PRT,Zeamays>  (45) G--------MEEA--AAAAAAKPE------------------P--AAEKA
    seqidno36,PRT,Arabidopsisthaliana>  (46) A--------------MD----------------------------SVSKV
    seqidno48,PRT,Arabidopsisthaliana>  (52) K--------------EG----------------------------SVDLK
    seqidno66,PRT,Arabidopsisthaliana> (150) ---------------ATQSVT------------------------KKDVP
                           Consensus (151)
```

FIGURE 11 (continued)

```
                                               201                                              250
        seqidno02,PRT,Oryzasativa>   (26) GSKQKSSTKETSFLSNNRVEVAPVVGWPPVRSSRRNLTAQLKEEMKKKES
 seqidno2,PRT,Arabidopsisthaliana>   (26) GSKQKSSTKETSFLSNNRVEVAPVVGWPPVRSSRRNLTAQLKEEMKKKES
seqidno14,PRT,Arabidopsisthaliana>   (67) LRTIQHEIYHSSG------------------------------------Q
seqidno24,PRT,Arabidopsisthaliana>   (36) LRTIQHETYLPPARMIGLDGYGELIDWSQPSYNSITQLKSEDTGHQRLAQ
           seqidno228,PRT,Zeamays>   (44) VVTVASVGHDPPPPALSVDAESDQLSQPSHANKATDAPAASSDRSPNETE
        seqidno84,PRT,Oryzasativa>   (53) LLLFDDGSCCNTSDDDCRRRKKTVVGWPPVSSARR---ACG---------
       seqidno102,PRT,Oryzasativa>   (59) TDDDPDNRLGSTATESPPSPKARVVGWPPVRAFRKNALAALAAASS----
       seqidno108,PRT,Oryzasativa>    (1) ----MAR---------RGGRRARVVGWPPVRAFRKNALAALAAASS----
       seqidno126,PRT,Oryzasativa>   (48) ADHADAK---------PPSPKARAVGWPPVRAYRRNALREDSAR------
       seqidno180,PRT,Oryzasativa>   (49) ADHADAK---------PPSPKARAVGWPPVRAYRRNALREDAAR------
seqidno22,PRT,Arabidopsisthaliana>   (48) TVDLKLGEAHENNYISSMVTNDQLVGWPPVATARKTVR------------
seqidno54,PRT,Arabidopsisthaliana>   (34) SNN-KRKNNDSTEESAPPPAKTQIVGWPPVRSNRK---------------
       seqidno120,PRT,Oryzasativa>   (88) AAEAEEEEEKKKAQAP--AAKAQVVGWPPIRSYRKNTMAMSQPALKGKDD
       seqidno144,PRT,Oryzasativa>  (101) EEVGAEEEDKKVAAPPQPAAKAQVVGWPPIRSYRKNTMATNQIKSN-KED
        seqidno72,PRT,Oryzasativa>  (101) EEVGAEEEDKKVAAPPQPAAKAQVVGWPPIRSYRKNTMATNQIKSN-KED
           seqidno210,PRT,Zeamays>   (81) KKVAEEEDDKKVAATPQPVAKAQVVGWPPIRSYRKNTMSTTQLKGS-KED
       seqidno174,PRT,Oryzasativa>  (106) EEEEEEKGLGEAAAGAPRAAKAQVVGWPPVRSYRKNTLAASATKTKGEDQ
           seqidno198,PRT,Zeamays>    (1) --------------------------------------------------
       seqidno138,PRT,Oryzasativa>  (103) --SVVTAAADPE---KPRAPKAQVVGWPPVRSYRKNILAVQADK--GKDA
       seqidno192,PRT,Oryzasativa>  (103) --SVVTAAADPE---KPRAPKAQVVGWPPVRSYRKNILAVQADK--GKDA
           seqidno234,PRT,Zeamays>   (93) SVAAAAVLADPAE--KPRAAKAQVVGWPPVRSFRKNIMSVQSDKGAGKDA
       seqidno156,PRT,Oryzasativa>    (1) -----------------MSIRAQVVGWPPVRSFRKNVLAEKCKA------
        seqidno90,PRT,Oryzasativa>   (83) --SVVTAEPDPD---KPRAPKAQVVGWPPVRSFRKNVLAEKCKA------
       seqidno162,PRT,Oryzasativa>   (67) KRPAEAAAADAE---KPPAPKAQAVGWPPVRSFRRNIMTVQSVKSKKEEE
           seqidno216,PRT,Zeamays>   (65) KRPAEAPAADAE---KPPAPKAQAVGWPPVRSYRRNVMTVQSVKSKKEEE
seqidno36,PRT,Arabidopsisthaliana>   (54) DLENMKEK------VVKPPAKAQVVGWPPVRSFRKNVMSGQKPTTGDATE
seqidno48,PRT,Arabidopsisthaliana>   (60) NVSAVPKEKTTLKDPSKPPAKAQVVGWPPVRNYRKNMMTQQKTSSGAEEA
seqidno66,PRT,Arabidopsisthaliana>  (161) QNIPKGQSSTTNNSSSPPAAKAQIVGWPPVRSYRKNTLATTCKNSD----
                         Consensus  (201)                   A KAQVVGWPPVRSYRKN LA

                                               251                                              300
        seqidno02,PRT,Oryzasativa>   (76) DEEK----------------ELYVKINMEGVPIGRKVNLSAYNNYQQLSH
 seqidno2,PRT,Arabidopsisthaliana>   (76) DEEK----------------ELYVKINMEGVPIGRKVNLSAYNNYQQLSH
seqidno14,PRT,Arabidopsisthaliana>   (81) RYCSNEG---------YRRKWGYVKVTMDGLVVGRKVCVLDHGSYSTLAH
seqidno24,PRT,Arabidopsisthaliana>   (86) GYYNNEGE--------SRGKYAYVKVNLDGLVVGRKVCLVDQGAYATLAL
           seqidno228,PRT,Zeamays>   (94) -SR---------------QARSCTKVIMQGVAVGRAVDLTRLDGYDDLRR
        seqidno84,PRT,Oryzasativa>   (91) -------------------GANYVKVKKEGDAIGRKVDLALHSSYDELAA
       seqidno102,PRT,Oryzasativa>  (105) ------------------SKAKFVKVAVDGAPYLRKVDLEAYRGYDQLLA
       seqidno108,PRT,Oryzasativa>   (34) ------------------SKAKFVKVAVDGAPYLRKVDLEAYRGYDQLLA
       seqidno126,PRT,Oryzasativa>   (83) --------------------AKLVKVAVDGAPYLRKVDLAAHAGYAPLLR
       seqidno180,PRT,Oryzasativa>   (84) --------------------AKLVKVAVDGAPYLRKVDLAAHAGYAPLLR
seqidno22,PRT,Arabidopsisthaliana>   (86) ----------------R----KYVKVALDGAAYLRKVDLGMYDCYGQLFT
seqidno54,PRT,Arabidopsisthaliana>   (68) ----NNNN----------KNVSYVKVSMDGAPYLRKIDLKMYKNYPELLK
       seqidno120,PRT,Oryzasativa>  (136) GEAKQAPA----------SGCLYVKVSMDGAPYLRKVDLKMYKNYKELSL
       seqidno144,PRT,Oryzasativa>  (150) VDAKQG------------QGFLYVKVSMDGAPYLRKVDLKTYKNYKDMSL
        seqidno72,PRT,Oryzasativa>  (150) VDAKQG------------QGFLYVKVSMDGAPYLRKVDLKTYKNYKDMSL
           seqidno210,PRT,Zeamays>  (130) AEAKQD------------QGFLYVKVSMDGAPYLRKIDLKTYKNYKDLST
       seqidno174,PRT,Oryzasativa>  (156) GKSEVG------------C--CYVKVSMDGAPYLRKVDLKTYSSYEDLSL
           seqidno198,PRT,Zeamays>    (1) ---------------------MYVKVSMDGAPYLRKVDIKMYSSYEDLSV
       seqidno138,PRT,Oryzasativa>  (146) ADGGGDKS---GAGAAA---AAFVKVSMDGAPYLRKVDLKMYKSYLELSK
       seqidno192,PRT,Oryzasativa>  (146) ADGGGDKS---GAGAAA---AAFVKVSMDGAPYLRKVDLKMYKSYLELSK
           seqidno234,PRT,Zeamays>  (141) AAANGDKS---SAAAGG--GAAFVKVSLDGAPYLRKVDLKMYRSYQQLSK
       seqidno156,PRT,Oryzasativa>   (28) --------------------AALVKVSMDGAPYLRKIDVAMYKSYPELSM
        seqidno90,PRT,Oryzasativa>  (122) --------------------AALVKVSMDGAPYLRKIDVAMYKSYPELSM
       seqidno162,PRT,Oryzasativa>  (114) ADKQQQQP---AANASGSNSSAFVKVSMDGAPYLRKVDLKMYNSYKDLSL
           seqidno216,PRT,Zeamays>  (112) PEKQQS-----AANAGG-NGSAFVKVSMDGAPYLRKVDLKMYNSYTELSV
seqidno36,PRT,Arabidopsisthaliana>   (98) GNDKTSGSSGATSSASACATVAYVKVSMDGAPYLRKIDLKLYKTYQDLSN
seqidno48,PRT,Arabidopsisthaliana>  (110) SSEKAG------NFGGGAAGAGLVKVSMDGAPYLRKVDLKMYKSYQDLSD
seqidno66,PRT,Arabidopsisthaliana>  (207) -EVDGRPG----------SGALFVKVSMDGAPYLRKVDLRSYTNYGELSS
                         Consensus  (251)                     A YVKVSMDGAPYLRKVDLKMYK Y DLS
```

FIGURE 11 (continued)

```
                                                  301                                                350
        seqidno02,PRT,Oryzasativa>        (110) AVDQLFSKKDSWDLN---------------------RQYTLVYEDTEGDK
  seqidno2,PRT,Arabidopsisthaliana>       (110) AVDQLFSKKDSWDLN---------------------RQYTLVYEDTEGDK
 seqidno14,PRT,Arabidopsisthaliana>       (122) QLEDMFGMQSVSGLR----------------LFQMESEFCLVYRDEEGLW
 seqidno24,PRT,Arabidopsisthaliana>       (128) QLNDMFGMQTVSGLR----------------LFQTESEFSLVYRDREGIW
            seqidno228,PRT,Zeamays>       (128) KLEEMFDIPGELSAS--------------------LKKWKVIYTDDEDDM
        seqidno84,PRT,Oryzasativa>        (122) TLARMFPTNDHQGEK-----------KMANDDHGDAAGPVVTYEDGDGDW
       seqidno102,PRT,Oryzasativa>        (137) ALQDKFFSHFTIPRERGDEA-RRRGERQRVRADVRGQGRRLDARRRRPLE
       seqidno108,PRT,Oryzasativa>         (66) ALQDKFFSHFTIR--------KLGNEEMKLVDAVSGNEYVPTYEDKDGDW
       seqidno126,PRT,Oryzasativa>        (113) ALHGMFASCLAVR----GGG-GGDGEGTKLVDLVTGAEYVPTYEDKDGDW
       seqidno180,PRT,Oryzasativa>        (114) ALHGMFASCLAVR----GGA-GGDGEGTKLVDLVTGAEYVPTYEDKDGDW
 seqidno22,PRT,Arabidopsisthaliana>       (116) ALENMFQGIITICRVTELER---------------KGEFVATYEDKDGDL
 seqidno54,PRT,Arabidopsisthaliana>       (104) ALENMFKFTVGEYSE---------------REGYKGSGFVPTYEDKDGDW
       seqidno120,PRT,Oryzasativa>        (176) ALEKMFSCFTVGHGESNGKSGRDGLSDCRLMDLKNGTELVLTYEDKDEDW
       seqidno144,PRT,Oryzasativa>        (188) GLEKMFIGFSTGKEGAENQK---------------DGEYVLTYEDKDGDW
        seqidno72,PRT,Oryzasativa>        (188) GLEKMFIGFSTGKEGAENQK---------------DGEYVLTYEDKDGDW
            seqidno210,PRT,Zeamays>       (168) ALEKMFSGFSTG-----------------------EMSRVTLLSRMARQY
       seqidno174,PRT,Oryzasativa>        (192) ALEKMFSCFITGRSSSHKTSKRDRLTDGSRADALKDQEYVLTYEDKDADW
            seqidno198,PRT,Zeamays>        (30) ALQKMFSCFIAGQSGLHKSSSKDRLTNGSKVDALKDQEYVLTYEDKDADW
       seqidno138,PRT,Oryzasativa>        (190) ALEKMFSSFTIGNCG-SHGV--NGMNESKIADLLNGSEYVPTYEDKDGDW
       seqidno192,PRT,Oryzasativa>        (190) ALEKMFSSFTIGNCG-SHGV--NGMNESKIADLLNGSEYVPTYEDKDGDW
            seqidno234,PRT,Zeamays>       (186) ALENMFSSFTIGSCG-SQGM--NGMNESKLVDLLNGSEYVPTYEDKDGDW
       seqidno156,PRT,Oryzasativa>         (58) AFQNMFTSFTIGKCG-SHQQ--LKESNK----LRDDLEYVPTYEDKDGDW
        seqidno90,PRT,Oryzasativa>        (152) AFQNMFTSFTIGKCG-SHQQ--LKESNK----LRDDLEYVPTYEDKDGDW
       seqidno162,PRT,Oryzasativa>        (161) ALQKMFGTFTAT-----G----NNMN------EVNGSDAVTTYEDKDGDW
            seqidno216,PRT,Zeamays>       (156) ALKKMFSTFTTS-----G----NNMNEGKLVDPVSGADVVTTYEDKDGDW
 seqidno36,PRT,Arabidopsisthaliana>       (148) ALSKMFSSFTIGNYGPQGMK--DFMNESKLIDLLNGSDYVPTYEDKDGDW
 seqidno48,PRT,Arabidopsisthaliana>       (154) ALAKMFSSFTMGNYGAQGMI--DFMNESKLMNLLNSSEYVPSYEDKDGDW
 seqidno66,PRT,Arabidopsisthaliana>       (246) ALEKMFTTFTLGQCGSNGAAGKDMLSETKLKDLLNGKDYVLTYEDKDGDW
                         Consensus        (301) ALEKMFSSFT G                     D L G EYV TYEDKDGDW

                                                  351                                                400
        seqidno02,PRT,Oryzasativa>        (139) VLVGDVPWEMFVSTVKRLHVLKTSHASSLSPRKHGKE-------------
  seqidno2,PRT,Arabidopsisthaliana>       (139) VLVGDVPWEMFVSTVKRLHVLKTSHAFSLSPRKHGKE-------------
 seqidno14,PRT,Arabidopsisthaliana>       (156) RNAGDVPWNEFIESVERLRITRRNDAVLPF--------------------
 seqidno24,PRT,Arabidopsisthaliana>       (162) RNVGDVPWKEFVESVDRMRIARRNDALLPF--------------------
            seqidno228,PRT,Zeamays>       (158) MLVGDDPWSEFCRMVKRIYIYSYEEAKSLTPKAKLPAIGGDTGVKPDPSK
        seqidno84,PRT,Oryzasativa>        (161) MLVGDVPWDDFARSVKRLKILG----------------------------
       seqidno102,PRT,Oryzasativa>        (186) NVCGDLPTSSSHEKL-----------------------------------
       seqidno108,PRT,Oryzasativa>        (108) MLVGDVPWKMFVETCQRLRLMKSSEAVNLAPRSA----------------
       seqidno126,PRT,Oryzasativa>        (158) MLVGDVPWK-----------------------------------------
       seqidno180,PRT,Oryzasativa>        (159) MLVGDVPWKMFVESCKRIRLMKSSEAVNLSPRRSSR--------------
 seqidno22,PRT,Arabidopsisthaliana>       (151) MLVGDVPWMMFVESCKRMRLMKTGDAIGL---------------------
 seqidno54,PRT,Arabidopsisthaliana>       (139) MLVGDVPWDMFSSSCQKLRIMKGSEAPTAL--------------------
       seqidno120,PRT,Oryzasativa>        (226) MLVGDVPWRMFTDSCRRLRIMKGSDAVGLAPRATDKSKNRN---------
       seqidno144,PRT,Oryzasativa>        (223) MLVGDVPWEMFTDSCRRLRIMKGSDAIGLGCSQLRLVPLFVPKL------
        seqidno72,PRT,Oryzasativa>        (223) MLVGDVPWEMFTDSCRRLRIMKGSDAIGLAPRAGEKSKNRN---------
            seqidno210,PRT,Zeamays>       (195) VIVFHFDVDGVRSTSRSL--------------------------------
       seqidno174,PRT,Oryzasativa>        (242) MLVGDLPWDLFTTSCRKLRIMRGSDAAGIASDNLSNGNSYLLCPCSSEIT
            seqidno198,PRT,Zeamays>        (80) MLVGDLPWDYGDMQITEG--------------------------------
       seqidno138,PRT,Oryzasativa>        (237) MLVGDVPWEMFVESCKRLRIMKGSEAIGLAPRAMEKCKNRS---------
       seqidno192,PRT,Oryzasativa>        (237) MLVGDVPWEMFVESCKRLRIMKGSEAIGLAPRAMEKCKNRS---------
            seqidno234,PRT,Zeamays>       (233) MLVGDVPWEMFVESCKRLRIMKGSEAIGLAPRAMEKCKNRS---------
       seqidno156,PRT,Oryzasativa>        (101) MLVGDVPWEMFVESCKRLRIMKGSEAIGLAPRAVEKCKS-----------
        seqidno90,PRT,Oryzasativa>        (195) MLVGDVPWEMFVESCKRLRIMKGSEAIGLAPRAVEKCKS-----------
       seqidno162,PRT,Oryzasativa>        (196) MLVGDVPWQMFVESCKRLRIMKGSEAIGLAPRAKDKYKNKS---------
            seqidno216,PRT,Zeamays>       (197) MLVGDVPWEMFVESCRRLRIMKSSEAIGLAPRTKDKCKNRS---------
 seqidno36,PRT,Arabidopsisthaliana>       (196) MLVGDVPWEMFVDSCKRIRIMKGSEAIGLAPRALEKCKNRS---------
 seqidno48,PRT,Arabidopsisthaliana>       (202) MLVGDVPWE-----------------------------------------
 seqidno66,PRT,Arabidopsisthaliana>       (296) MLVGDVPWEMFIDVCKKLKIMKGCDAIGLAAAPRAMEKSKMRA-------
                         Consensus        (351) MLVGDVPWEMFVESCKRLRIMK SEAIGLAPR
```

FIGURE 11 (continued)

| | | 401 430 |
|---|---|---|
| seqidno02,PRT,Oryzasativa> | (176) | ------------------------------ |
| seqidno2,PRT,Arabidopsisthaliana> | (176) | ------------------------------ |
| seqidno14,PRT,Arabidopsisthaliana> | (186) | ------------------------------ |
| seqidno24,PRT,Arabidopsisthaliana> | (192) | ------------------------------ |
| seqidno228,PRT,Zeamays> | (208) | LPPESDVPQSDSDNSAPVAADKD------- |
| seqidno84,PRT,Oryzasativa> | (183) | ------------------------------ |
| seqidno102,PRT,Oryzasativa> | (201) | ------------------------------ |
| seqidno108,PRT,Oryzasativa> | (142) | ------------------------------ |
| seqidno126,PRT,Oryzasativa> | (167) | ------------------------------ |
| seqidno180,PRT,Oryzasativa> | (195) | ------------------------------ |
| seqidno22,PRT,Arabidopsisthaliana> | (180) | ------------------------------ |
| seqidno54,PRT,Arabidopsisthaliana> | (169) | ------------------------------ |
| seqidno120,PRT,Oryzasativa> | (267) | ------------------------------ |
| seqidno144,PRT,Oryzasativa> | (267) | ------------------------------ |
| seqidno72,PRT,Oryzasativa> | (264) | ------------------------------ |
| seqidno210,PRT,Zeamays> | (213) | ------------------------------ |
| seqidno174,PRT,Oryzasativa> | (292) | GTDRSEQIVARAFIIWTANVWTKFAVASFR |
| seqidno198,PRT,Zeamays> | (98) | ------------------------------ |
| seqidno138,PRT,Oryzasativa> | (278) | ------------------------------ |
| seqidno192,PRT,Oryzasativa> | (278) | ------------------------------ |
| seqidno234,PRT,Zeamays> | (274) | ------------------------------ |
| seqidno156,PRT,Oryzasativa> | (140) | ------------------------------ |
| seqidno90,PRT,Oryzasativa> | (234) | ------------------------------ |
| seqidno162,PRT,Oryzasativa> | (237) | ------------------------------ |
| seqidno216,PRT,Zeamays> | (238) | ------------------------------ |
| seqidno36,PRT,Arabidopsisthaliana> | (237) | ------------------------------ |
| seqidno48,PRT,Arabidopsisthaliana> | (211) | ------------------------------ |
| seqidno66,PRT,Arabidopsisthaliana> | (339) | ------------------------------ |
| Consensus | | |

FIGURE 11 (continued)

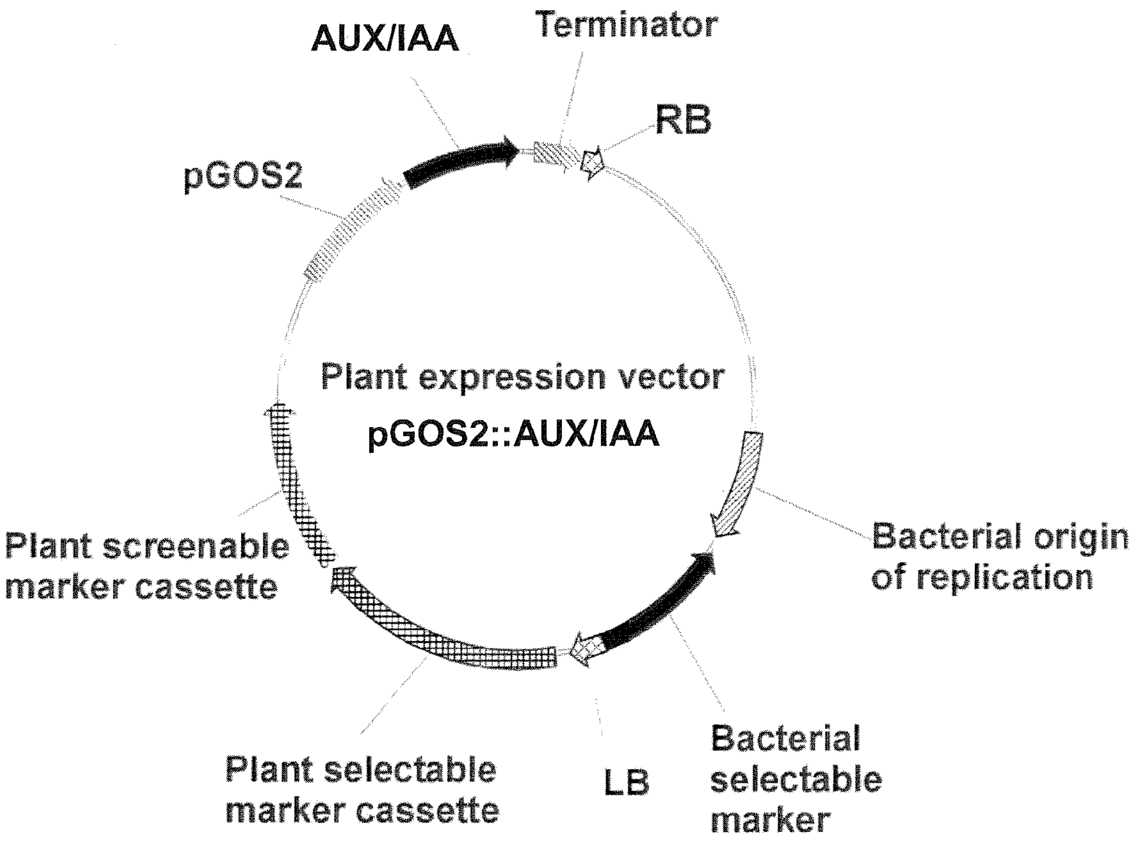

FIGURE 12

MNLKETELCLGLPGGTETVESPAKSGVGNKRGFSETVDL

Motif 1 Motif 2

KLNLQSNKQGHVDLNTNGAPKEKTFLKDPSKPPAKAQVV

GWPPVRNYRKNVMANQKSGEAEEAMSSGGGTVAFVKVSM

Motif 3

DGAPYLRKVDLKMYTSYKDLSDALAKMFSSFTMGSYGAQ

Motif 4

GMIDFMNESKVMDLLNSSEYVPSYEDKDGDWMLVGDVPW

Motif 5

PMFVESCKRLRIMKGSEAIGLAPRAMEKFKNRS

Motif 6 bold: AUX-IAA domain

FIGURE 13

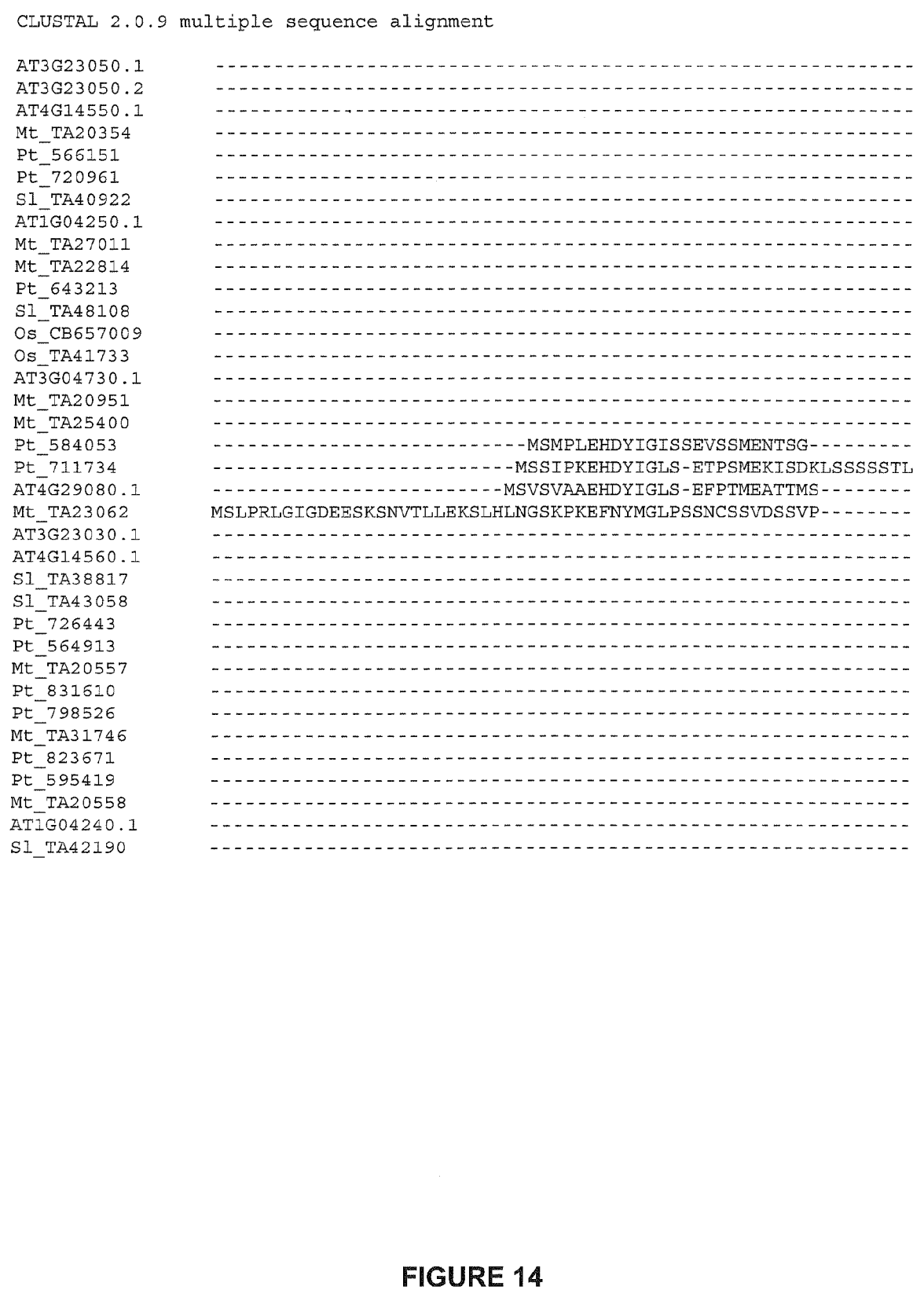

```
CLUSTAL 2.0.9 multiple sequence alignment

AT3G23050.1      ------------------------------------------------------------
AT3G23050.2      ------------------------------------------------------------
AT4G14550.1      ------------------------------------------------------------
Mt_TA20354       ------------------------------------------------------------
Pt_566151        ------------------------------------------------------------
Pt_720961        ------------------------------------------------------------
Sl_TA40922       ------------------------------------------------------------
AT1G04250.1      ------------------------------------------------------------
Mt_TA27011       ------------------------------------------------------------
Mt_TA22814       ------------------------------------------------------------
Pt_643213        ------------------------------------------------------------
Sl_TA48108       ------------------------------------------------------------
Os_CB657009      ------------------------------------------------------------
Os_TA41733       ------------------------------------------------------------
AT3G04730.1      ------------------------------------------------------------
Mt_TA20951       ------------------------------------------------------------
Mt_TA25400       ------------------------------------------------------------
Pt_584053        ---------------------------MSMPLEHDYIGISSEVSSMENTSG---------
Pt_711734        --------------------------MSSIPKEHDYIGLS-ETPSMEKISDKLSSSSSTL
AT4G29080.1      -------------------------MSVSVAAEHDYIGLS-EFPTMEATTMS--------
Mt_TA23062       MSLPRLGIGDEESKSNVTLLEKSLHLNGSKPKEFNYMGLPSSNCSSVDSSVP--------
AT3G23030.1      ------------------------------------------------------------
AT4G14560.1      ------------------------------------------------------------
Sl_TA38817       ------------------------------------------------------------
Sl_TA43058       ------------------------------------------------------------
Pt_726443        ------------------------------------------------------------
Pt_564913        ------------------------------------------------------------
Mt_TA20557       ------------------------------------------------------------
Pt_831610        ------------------------------------------------------------
Pt_798526        ------------------------------------------------------------
Mt_TA31746       ------------------------------------------------------------
Pt_823671        ------------------------------------------------------------
Pt_595419        ------------------------------------------------------------
Mt_TA20558       ------------------------------------------------------------
AT1G04240.1      ------------------------------------------------------------
Sl_TA42190       ------------------------------------------------------------
```

FIGURE 14

| | |
|---|---|
| AT3G23050.1 | ---------------MIGQLMNLKATELCLGLPGG------------------------- |
| AT3G23050.2 | ---------------MIGQLMNLKATELCLGLPGG------------------------- |
| AT4G14550.1 | --------------------MNLKETELCLGLPGG------------------------- |
| Mt_TA20354 | -------------MATMGHGLNLKETELCLGLPGGGGGGGG-G----------------- |
| Pt_566151 | -------MATATVLGTEMADLNYKETELCLGLPGAVG-----V----------------- |
| Pt_720961 | --------MTTSVLGTERTDLNYKETELCLGLPGAVG-----A----------------- |
| Sl_TA40922 | --------------------MDLKETELCLGLPGGGGGGGELI----------------- |
| AT1G04250.1 | --------------MMGSVELNLRETELCLGLPGG------------------------- |
| Mt_TA27011 | ------MEVVG---MKKE-NMGFEETELRLGIGFLGN----------------------- |
| Mt_TA22814 | ------MEVVAG--MKKEEKMVFDETELRLGLGLPG------------------------ |
| Pt_643213 | ------MEVEK------GTKMGFEETELRLGLPGNGG----------------------- |
| Sl_TA48108 | ------MSSNK---------LDFEETELRLGL--PGG----------------------- |
| Os_CB657009 | ------------------------------------------------------------ |
| Os_TA41733 | ----------------MAADLAFEATELRLGLPGGGG----------------------- |
| AT3G04730.1 | -------------------MINFEATELRLGLPGGNH----------------------- |
| Mt_TA20951 | ------MTNVGDAERDKYSLINFEETELRLGLPGAGD----------------------- |
| Mt_TA25400 | ------------------------------------------------------------ |
| Pt_584053 | -------TDTINISTTASKGLNLKATELRLGLPGSDSPERGNE----------NQQLGFS |
| Pt_711734 | STEENINSNSNSNSNSTNTSLNLKETELRLGLPGYQSPERKLT----------LPAAGVS |
| AT4G29080.1 | ---------DKTKTRDNNNGLNFKATELRLGLPGSESPER-------------VDSRFLA |
| Mt_TA23062 | --------KIQSFKDETKSNLNLKATELRLGLPGSLSPERDSSDFCLRSSKQFDEKPLFP |
| AT3G23030.1 | -----------MAYEKVNELN-LKDTELCLGLPGRTEKI--------------------- |
| AT4G14560.1 | -------------MEVTNGLN-LKDTELRLGLPGAQE----------------------- |
| Sl_TA38817 | ---------MECVLAHEKDLN-LKATELRLGLPGRTDE---------------------- |
| Sl_TA43058 | ---------MTSIVGNQKDLN-FKATELRLGLPGTEDQ---------------------- |
| Pt_726443 | ---------MEGGVAYENDLN-LKATELRLGLPG-TSC---------------------- |
| Pt_564913 | ---------MEGGVAYENDLN-LKETELRLGLPG-TGC---------------------- |
| Mt_TA20557 | ---------MENKVAYENDLN-MKATELRLGLPG-TEQ---------------------- |
| Pt_831610 | ------------MA-YESDLN-LKATELRLGLPGSDEP---------------------- |
| Pt_798526 | --------MERSMA-YERHLN-LKATELRLGLPGSDEP---------------------- |
| Mt_TA31746 | --------MENSLGNHQTEMN-LKATELRLGLPGSDEV---------------------- |
| Pt_823671 | -------------MEFERDLN-LDATELRLGLPGTATKQS-------------------- |
| Pt_595419 | -------------MEFERDLN-LEATELRLGLPGTATEQL-------------------- |
| Mt_TA20558 | -------------MEF-------KATELRLGLPGTDEK---------------------- |
| AT1G04240.1 | ---------------MDEFVN-LKETELRLGLPGTDNVC--------------------- |
| Sl_TA42190 | ------------MRIYEKDINDLEATELRLGLPGIIND---------------------- |

FIGURE 14 (continued)

```
AT3G23050.1    ------------AEAVESPAKSAVGSKRGFSET--------VDLMLNLQSNKEGS-----
AT3G23050.2    ------------AEAVESPAKSAVGSKRGFSET--------VDLMLNLQSNKEGS-----
AT4G14550.1    ------------TETVESPAKSGVGNKRGFSET--------VDLKLNLQSNKQGH-----
Mt_TA20354     ------------GSEVETPRAS---GKRGFSET--------VDLKLNLQTKE--------
Pt_566151      ------------KNEVETPNKAT--GKRGFAET--------VDLKLNLQAKEGVMDL---
Pt_720961      ------------KNEVETPNKAT--GKRGFAET--------VDLKLNLQAKEGVMDL---
Sl_TA40922     ------------RDNNNNNNKVN--GKRGFSET--------VDLKLNFHQASDDISC---
AT1G04250.1    --------------DTVAPVTGN---KRGFSET--------VDLKLNLNNEPANK-----
Mt_TA27011     ------------NG--SATATEGVVRKRGFSETETDDDTTTMDLMLNLSSKEATA-----
Mt_TA22814     -------------------KTTEVVRKRGFSETESESETNTVDLKLNLSTKEG-------
Pt_643213      ------------G------AEGEMVRKRGFSET--------VDLKLKLSSKES-------
Sl_TA48108     -------------------ARKNVYGDNDTCNVN--GKRGFVDLKLNLSSDIN-------
Os_CB657009    ------------------------------------------------------------
Os_TA41733     ------------DGDAAAAAARSSSGKRGFAET--------IDLKLKLEPAAAAVDDD--
AT3G04730.1    ------------GGEMAG----KNNGKRGFSET--------VDLKLNLS-----------
Mt_TA20951     ------------HGESPVK---NSCGKRGFSETA------NVDLKLNLSPIN--------
Mt_TA25400     ------------------------------------------------------------
Pt_584053      LNNNNSKD-----------KSFVSGARRGFSVAIHGGSANWVFSGNAGSDPNF-------
Pt_711734      LFGKDIDTNNTNGYPLRPLKNLVSGTKRGFSDAIVGSSGKWVFSGSNGSEVDLGKGAILF
AT4G29080.1    LNKS---------------SCPVSGAKRVFSDAIN-DSNKWVFS--PGSTTATG------
Mt_TA23062     LHPQKDDHLFES-------KPAVLGNKRGFSDAMNVFSEGKLKPSSKMLENVAG------
AT3G23030.1    -------------KEEQEVSCVKSNNKRLFEETR--------------------------
AT4G14560.1    -------------EQQLELSCVRSNNKRKNNDS---------------------------
Sl_TA38817     -------------ESDKEIVFHFKNNKRALPE--------------DEDC----------
Sl_TA43058     -------------ESDQEISNSKNNNKRALPESTHD----------EEDC----------
Pt_726443      -------------TNEEQAVSGARNNKRPLPET-------------REER----------
Pt_564913      -------------TNE-KGVSGARNNKRPFPET-------------REEG----------
Mt_TA20557     -------------NEE---QKAKISNKRPLTET-------------SKDS----------
Pt_831610      -------------EK-PSTTPSVRSNKRASPEISE-----------ESRSKG--------
Pt_798526      -------------EK-PSTTPSVRSNKRASPEISE-----------ESRSKG--------
Mt_TA31746     -------------EKLPCNFSVLRNNKRSSPEEASDV---------DSISKSKLN-----
Pt_823671      -------------EKQTPNSNLAKSNKRSLPDMNE-----------EPAGSSREN-----
Pt_595419      -------------EKQTPNSNVTKSNKRSLPDMNE-----------DSAG--RRE-----
Mt_TA20558     -------------DMKTIHGSVVKNNKRQLPQTSE-----------ESVS----------
AT1G04240.1    -------------EAKERVSCCNNNNKRVLSTDTEK----------EIES----------
Sl_TA42190     -------------ESSTSTSTSKNSRKRPSSSSVN-------------------------
```

FIGURE 14 (continued)

```
AT3G23050.1     --------------------------VDLKNVSAVPKEKTTL-KDPSKPPA---------
AT3G23050.2     --------------------------VDLKNVSAVPKEKTTL-KDPSKPPA---------
AT4G14550.1     --------------------------VDLN-TNGAPKEKTFL-KDPSKPPA---------
Mt_TA20354      ---------------------------DLNEKSAS-KEKTLL-KDPAKPPA---------
Pt_566151       ----------------------NENIKNIASKDKNHLPADTI-KDPAKPPA---------
Pt_720961       ----------------------NENIKNITSKDKNHLPAVTI-KDPAKPPA---------
Sl_TA40922      ----------------------AMENNKMKSSVTTTKEVVCN-KDPIKPPA---------
AT1G04250.1     -----------------------EGSTTHDVVTFDSKEKSACPKDPAKPPA---------
Mt_TA27011      ----------------------EVDPSDITTKTLQKEKTLLPADP-AKPPA---------
Mt_TA22814      ----------------------ATDP-----QFKPKEKALLLSDSGAKPPA---------
Pt_643213       ----------------------GADPNHEKTSSLQREKNLLATDP-AKPPA---------
Sl_TA48108      ---------------------------------------NIKNSTHKTPAA---------
Os_CB657009     ------------------------------------------------------------
Os_TA41733      ----------------------DDKEEAAADDREKKVDIVGADNDDASPPAAAAAGGMKR
AT3G04730.1     ---------------------------STAMDSVSKVDLENMKEKVVKPPA---------
Mt_TA20951      ---------------------------DSASSSSTIASVAENKGKDTTTSATVSP-----
Mt_TA25400      ------------------------------------------------------------
Pt_584053       SLRGANSG-----------KEGFPHSSKPVVQENKSQVDGANTNGHGAAPAS--------
Pt_711734       SPRGDNGNSQKSCVAGPAKKDDVAQSPKP-VQEKISQVAAANEN--SSAPAA--------
AT4G29080.1     -DVGSGSGP----------RTSVVKDGKS-TTFTKPAVPVKEKKSSATAPAS--------
Mt_TA23062      QKVKADEIA----------TVKIGLERPNGVGESKPGLNGSANNGNSTAPAS--------
AT3G23030.1     ------------------------------------------DEEESTPP----------
AT4G14560.1     ------------------------------------------TEESAPPP----------
Sl_TA38817      -------------------------------ESN-----SISD-PKTPP-----------
Sl_TA43058      -------------------------------ESK-----SSSDHVKTPPP----------
Pt_726443       -------------------------------GAKGKSDPRHDDQETAPAP----------
Pt_564913       -------------------------------GANGKSDAQHDDQETASAPNTYSFDMHA-
Mt_TA20557      -------------------------------GSK-----TSDD---AAPPS---------
Pt_831610       -------------------------------SSSVSSNVEN-GERDSAPP----------
Pt_798526       -------------------------------SSSLSSNVEN-SEGDDAPP----------
Mt_TA31746      -------------------------------SSNGSSHTTN-DDQDNAPP----------
Pt_823671       -------------------------------SSTVSSNDKKSHDQETAPP----------
Pt_595419       -------------------------------SSSVSSNDKKSHEQETAPP----------
Mt_TA20558      -------------------------------ISKVSNDDQHVESSSAAPP----------
AT1G04240.1     ----------------------------------------SSRKTETSPP----------
Sl_TA42190      ---------------------------------------ENEQQDSAPAP----------
```

FIGURE 14 (continued)

```
AT3G23050.1     --------------------KAQVVGWPPVRNYRKNMMTQQKTSSG--------------
AT3G23050.2     --------------------KAQVVGWPPVRNYRKNMMTQQKTSSG--------------
AT4G14550.1     --------------------KAQVVGWPPVRNYRKNVMANQKSGE---------------
Mt_TA20354      --------------------KAQVVGWPPVRSYRKNMMAQKVNNTE--------------
Pt_566151       --------------------KAQVVGWPPVRSYRKNVLAQKNASEEGFRAQVVGWPPLRS
Pt_720961       --------------------KAQVVGWPPVRSYRKNVMAQKNASEE--------------
Sl_TA40922      --------------------KAQVVGWPPVRSFRKNVMAQKSNTEE--------------
AT1G04250.1     --------------------KAQVVGWPPVRSYRKNVMVSCQKSSG--------------
Mt_TA27011      --------------------KAQVVGWPPVRSYRKNMLAMQKS-----------------
Mt_TA22814      --------------------KAQVVGWPPVRSFRKNMFAAQKSNEGS-------------
Pt_643213       --------------------KAQVVGWPPVRSFRKNMLAVQKSS-TD-------------
Sl_TA48108      --------------------KAQVVGWPPVRSFRKNILTSQKLD----------------
Os_CB657009     ------------------------------------------------------------
Os_TA41733      SPSQSSVVTAAADPEKPRAPKAQVVGWPPVRSYRKNILAVQADKGKD-------------
AT3G04730.1     --------------------KAQVVGWPPVRSFRKNVMSGQKPTTGD-------------
Mt_TA20951      ----------------PPRAKAQVVGWPPVRSFRKNIVNVHQ-KSNS-------------
Mt_TA25400      ----------------------------MMKLREN-------------------------
Pt_584053       --------------------KAQVVGWPPIRSFRKNTMASHLS-----------------
Pt_711734       --------------------KAQVVGWPPIRSFRKNTMASSLV-----------------
AT4G29080.1     --------------------KAQVVGWPPIRSFRKNSMASSQSQKPG-------------
Mt_TA23062      --------------------KAQVVGWPPIRSFRKNSLTTAS------------------
AT3G23030.1     -------------------TKTQIVGWPPVRSSRKNNNS---------------------
AT4G14560.1     -------------------AKTQIVGWPPVRSNRKNNNNK--------------------
Sl_TA38817      ------------------VAKTQIVGWPPVRANRKNSFPSKK------------------
Sl_TA43058      ------------------VAKAQIVGWPPVRSNRKNIIQPKK------------------
Pt_726443       --------------------KAQIVGWPPIRSYRKNTLQPKKA-----------------
Pt_564913       ------------------TCRVQIVGWPPIRSYRKNSLQPKKA-----------------
Mt_TA20557      --------------------KAKIVGWPPIRSYRKNSLQ---------------------
Pt_831610       -------------------AKAQVVGWPPIRSYRKNCLQPKKN-----------------
Pt_798526       -------------------AKAQVVGWPPIRSYRKNCLQPKKN-----------------
Mt_TA31746      -------------------SKAQVVGWPPIRSYRKNSLQQKKG-----------------
Pt_823671       -------------------IKAQVVGWPPIRSYRKNCLQAKK------------------
Pt_595419       -------------------TKTQVVGWPPIRSYRKNCLQARK------------------
Mt_TA20558      -------------------AKAKIVGWPPIRSYRKNTLQ---------------------
AT1G04240.1     -------------------RKAQIVGWPPVRSYRKNNIQSKKNE----------------
Sl_TA42190      --------------------KAQVVGWPPVRSYRKNHVSKLSE-----------------
```

FIGURE 14 (continued)

```
AT3G23050.1     ------AEEASSEKAGNFGGGAAGAGLVKVSMDGAPYLRKVDLKMYKSYQDLSDALAKMF
AT3G23050.2     ------AEEASSEKAGNFGGGAAGAGLVKVSMDGAPYLRKVDLKMYKSYQDLSDALAKMF
AT4G14550.1     ------AEEAMSS-----GGGTV--AFVKVSMDGAPYLRKVDLKMYTSYKDLSDALAKMF
Mt_TA20354      ------DTEKTTS-------NTTAAAFVKVSMDGAPYLRKVDLTMYKTYKDLSDALAKMF
Pt_566151       YRKNVLTQKNASEEGDKASTGGSSAAFVKVCMDGAPYLRKVDLKMYKSYQELSDALAKMF
Pt_720961       --------------GEKASTGGSSAAFVKVCMDGAPYLRKVDLKMYRSYQELSDALAKMF
Sl_TA40922      -------------------SEKTTAAFVKVCMDGAPYLRKVDLKMYKSYQELSDALAKMF
AT1G04250.1     --------------------GPEAAAFVKVSMDGAPYLRKIDLRMYKSYDELSNALSNMF
Mt_TA27011      --ESEKNSSSNFN----------AITFVKVSMDGAPYLRKVDLKMYTSYSQLSDSLGKMF
Mt_TA22814      -EESEKKNS-NNN----------PISFVKVSMDGAPYLRKVDLKMYKSYPELSDALAKMF
Pt_643213       -QECEKVPG---G----------NATFVKVSMDGAPYLRKVDLKMYKTYQELSDALGKMF
Sl_TA48108      ---RENDN-----------------ILVKVSMDGAPYLRKVDLNMYKSYQELFDALTKMF
Os_CB657009     ------------------------------------------------------------
Os_TA41733      -AADGGGDKSGAG--------AAAAAFVKVSMDGAPYLRKVDLKMYKSYLELSKALEKMF
AT3G04730.1     -ATEGNDKTSGSSGATSSASACATVAYVKVSMDGAPYLRKIDLKLYKTYQDLSNALSKMF
Mt_TA20951      -ETEVDKSISGGG---------GNGAFVKVSMDGAPYLRKVDLKLYKSYQELSDALAKMF
Mt_TA25400      QNFD--------------------CLYVKVSMDGAPYLRKVDLKTYNNYMELSSALEKMF
Pt_584053       KNDDGAEVKSGSG-----------CLYVKVSMDGAPYLRKVDLKTFGSYMELSSALEKMF
Pt_711734       KNNEDVEGKSGYG-----------CLYVKVSMDGAPYLRKVDLKTYSNYLELSSALEKMF
AT4G29080.1     NNSETEEAEAKSGPE-------QPCLYVKVSMEGAPYLRKIDLKTYKSYLELSSALEKMF
Mt_TA23062      KNTEEVDGKLGSGG----------AVFVKVSMDGAPYLRKVDLKNYTAYSELSSSLEKMF
AT3G23030.1     ------------------------VSYVKVSMDGAPYLRKIDLKTYKNYPELLKALENMF
AT4G14560.1     -----------------------NVSYVKVSMDGAPYLRKIDLKMYKNYPELLKALENMF
Sl_TA38817      -------------------AEAECGMYVKVSMDGAPYLRKIDLKLYKGYPELLKALEKMF
Sl_TA43058      -------------------TESESGMYVKVSMDGAPYLRKIDLKMYKCYQELLKALENMF
Pt_726443       ------------------EAEAAAGMYVKVSMDGAPYLRKIDLKVYKGYPELLKALENMF
Pt_564913       ------------------EDEAAAGMYVKVSMDGAPYLRKIDLKVYKGYPELLKALENMF
Mt_TA20557      -------------------EAEASGIYVKVSLDGAPYLRKIDLRVYGGYAQLLKALESMF
Pt_831610       ------------------DQVDGAGMYVKVSVDGAPYLRKIDLKVYKSYPELLKALENMF
Pt_798526       ------------------DRVDGAGMYVKVSVDGAPYLRKIDLKVYRSYPELLKALEDMF
Mt_TA31746      ------------------EEVG---MYLKVSMAGAPYLRKIDLKVYKSYSELLKVLENMF
Pt_823671       ------------------LEAEAAGLYVKVSMDGAPYLRKIDLKVYKGYPELLKALEEMF
Pt_595419       ------------------LEAEAAGLYVKVSMDGAPYLRKIDLKVYKGYPELLEVVEEMF
Mt_TA20558      -------------------EAEVGGIYVKVSMDGAPYLRKIDLRIYGGYPELLKALETMF
AT1G04240.1     ------------------SEHEGQGIYVKVSMDGAPYLRKIDLSCYKGYSELLKALEVMF
Sl_TA42190      ------------------SDNNSSGMYLKVSMDGAPYLRKIDLQVYKSYQELLKALQSMF
```

FIGURE 14 (continued)

```
AT3G23050.1      SSFTMGNYGAQ--GMIDFMNES-KLMNLLNSSEYVPSYEDKDGDWMLVGDVPWEMFVESC
AT3G23050.2      SSFTMGNYGAQ--GMIDFMNES-KLMNLLNSSEYVPSYEDKDGDWMLVGDVPWE------
AT4G14550.1      SSFTMGSYGAQ--GMIDFMNES-KVMDLLNSSEYVPSYEDKDGDWMLVGDVPWPMFVESC
Mt_TA20354       SSFTTGNYGAQ--GMIDFMNES-KLMDLLNSSEYVPTYEDKDGDWMLVGDVPWEMFVGSC
Pt_566151        SSFTMGNYGAQ--GMIDFMNES-KLMDLLNSSEYVPSYEDKDGDWMLVGDVPWEMFVDSC
Pt_720961        SSFTMGNYGAQ--GMIDFMNES-KLMDLLNSSEYVPSYEDKDGDWMLVGDVPWEMFVNSC
Sl_TA40922       SSFTNGNYGSQ--GMIDFMNES-KLMDLLNSSEYVPTYEDKDGDWMLVGDVPREMFGDSC
AT1G04250.1      SSFTMGKHGGEE-GMIDFMNER-KLMDLVNSWDYVPSYEDKDGDWMLVGDVPWPMFVDTC
Mt_TA27011       SSFTIGNCESQ--GMKDFMNES-KLMDLLNNSDYVPTYEDKDGDWMLVGDVPWEMFVESC
Mt_TA22814       NSFTTGNCESQ--GIKDFMNESNKLMDLLNSSDYVPTYEDKDGDWMLVGDVPWEMFIDSC
Pt_643213        SSFTIGNCGSH--GLKDFLNES-KLIDLLNGTDYVPTYEDKDGDWMLVGDVPWDMFVESC
Sl_TA48108       NSFTI----VQ--GMKDFMHEG-KLMDLLNSSDYVPTYEDKDGDWMLVGDVPWGMFVDSC
Os_CB657009      -----------------MNES-KIADLLNGSEYVPTYEDKDGDWMFVGDVPWEMFVESC
Os_TA41733       SSFTIGNCGSH--GVNG-MNES-KIADLLNGSEYVPTYEDKDGDWMLVGDVPWEMFVESC
AT3G04730.1      SSFTIGNYGPQ--GMKDFMNES-KLIDLLNGSDYVPTYEDKDGDWMLVGDVPWEMFVDSC
Mt_TA20951       SSFTIDNCGSQ--VTKDFMNES-KLIDLLNGSDYVPTYEDKDGDWMLVGDVPWEMFVQSC
Mt_TA25400       TCFTIGQCNSPGLPGKDGLSES-SLRDLLHGSEYVLTYEDKDGDWMLVGDVPWGMFADSC
Pt_584053        SCFTIGQCGSHVVPGQDGLSES-RLMDLLHGSEYVLTYEDKDNDWMLVGDVPWKMFTDSC
Pt_711734        SCFTIGQCGSHGLRGQDGLTES-RLKDILHGSEYVLTYEDKDGDWMLVGDVPWDMFTNSC
AT4G29080.1      SCFTIGQFGSHGGCGRDGLNES-RLTDLLRGSEYVVTYEDKDSDWMLVGDVPWEMFICSC
Mt_TA23062       SCFTIGQCESH---GNQMLNET-KLRDLLHGSEYVITYEDKDGDWMLVGDVPWEMFIDTC
AT3G23030.1      K-VMIGEYCER----EG-----------YKGSGFVPTYEDKDGDWMLVGDVPWDMFSSSC
AT4G14560.1      K-FTVGEYSER----EG-----------YKGSGFVPTYEDKDGDWMLVGDVPWDMFSSSC
Sl_TA38817       K-LSIGEYSER----EG-----------YKGSEFAPAYEDKDGDLMLVGDVPFEMFLSSC
Sl_TA43058       K-LTIGEYSER----EG-----------YKGSEFAPAYEDKDGDLMLVGDVPWEMFMSSC
Pt_726443        K-LTIGEYSER----EG-----------YKGSEYAPTYEDKDGDWMLIGDVPWDMFLSSC
Pt_564913        K-LTIGEYSER----EG-----------YKGSEYAPTYEDKDGDWMLVGDVPWDMFLSSC
Mt_TA20557       K-LTIGNYSEK----EG-----------YKGSEYEPTYEDKDGDWMLVGDVPWEMFVTSC
Pt_831610        K-LTIGEYSEN----EG-----------YNGSEFAPTYEDKDGDWMLVGDVPWDMFISSC
Pt_798526        K-LTIGEYSEK----EG-----------YNGSDFAPTYEDKDGDWMLVGDVPWDMFISTC
Mt_TA31746       K-CTIGEYSER----EG-----------YNGSEFVPTYEDKDGDWMLVGDVPWEMFMSSC
Pt_823671        K-SKVGEYSER----EG-----------YNGSEHVPTYEDKDGDWMLVGDVPWDMFINSC
Pt_595419        K-FKVGEYSER----EG-----------YNGSEYVPTYEDKDGDWMLVGDVPWEMFINSC
Mt_TA20558       K-LTIGEYSER----EG-----------YKGSEYAPTYEDKDGDWMLVGDVPWDMFVTSC
AT1G04240.1      K-FSVGEYFER----DG-----------YKGSDFVPTYEDKDGDWMLIGDVPWEMFICTC
Sl_TA42190       K-CTIGVYSER----EG-----------YNGSDYAPTYEDKDGDWMLVGDVPWEMFISSC
                                            ..   .   :*****.*  *::****
```

FIGURE 14 (continued)

```
AT3G23050.1    KRLRIMKGSEAVGLAPRAMEKYCKNRS---------------------------------
AT3G23050.2    ------------------------------------------------------------
AT4G14550.1    KRLRIMKGSEAIGLAPRAMEKFKNRS----------------------------------
Mt_TA20354     KRLRIMKGSEAIGLAPRAMEKCKNRS----------------------------------
Pt_566151      KRLRIMKGSEAIGLAPRAMEKCKSRT----------------------------------
Pt_720961      KRLRIMKGSEAIGLAPRAMEKCKSRT----------------------------------
Sl_TA40922     KRLRIMKGSEAIGLAPRAMEKCKSRI----------------------------------
AT1G04250.1    KRLRLMKGSDAIGLAPRAMEKCKSRA----------------------------------
Mt_TA27011     KRLRIMKGKEAIGYSTKSYGKMQEQELDLLVALVRHLLHLLSYFGTCRMFSIVNLCNVIW
Mt_TA22814     KRLRIMKGKEAIGLAPRAMEKCKNRS----------------------------------
Pt_643213      KRLRIMKGTEATGLAPRAMEKCKNRSYK--------------------------------
Sl_TA48108     KRLRIMKGTEAIGLAPRAMEKCKNRNG---------------------------------
Os_CB657009    KRLRIMKGSEAIGLAPRAMEKCKNRS----------------------------------
Os_TA41733     KRLRIMKGSEAIGLAPRAMEKCKNRS----------------------------------
AT3G04730.1    KRIRIMKGSEAIGLAPRALEKCKNRS----------------------------------
Mt_TA20951     KRLRIMKGSEAIGLAPRAVEKCKNRS----------------------------------
Mt_TA25400     RRLRIMKGSDAIGLAPRAMEKSRSQN----------------------------------
Pt_584053      RRLRIMKGSEAIGLAPRAMEKCKSRN----------------------------------
Pt_711734      RRLRIMKGSEAIGLAPRAMEKCKNRN----------------------------------
AT4G29080.1    KKLRIMKSSEAIGLAPRVMEKCRSRN----------------------------------
Mt_TA23062     RRLRIMKSSDAIGLAPRAVEKSKSRN----------------------------------
AT3G23030.1    KRLRIMKGSDAPALDSSL------------------------------------------
AT4G14560.1    QKLRIMKGSEAP---TAL------------------------------------------
Sl_TA38817     KRLRIMKGSEARGLGCGV------------------------------------------
Sl_TA43058     KRLRIMKGSETRGLGCGV------------------------------------------
Pt_726443      KKLRIIKGSEATG-----------------------------------------------
Pt_564913      KKLRIMKGSEAIGLGCGA------------------------------------------
Mt_TA20557     KRLRIMKGTEARGV----------------------------------------------
Pt_831610      KRLRIMKGSEARGLGC--------------------------------------------
Pt_798526      KRLRIMKGSEARGLGC--------------------------------------------
Mt_TA31746     KRLRIMKGSEAKGLGCF-------------------------------------------
Pt_823671      KRLRIMKESEARGLGCAV------------------------------------------
Pt_595419      KRLRIMKESEARGLGCAV------------------------------------------
Mt_TA20558     KRLRIMKGTEARGLGCGV------------------------------------------
AT1G04240.1    KRLRIMKGSEAKGLGCGV------------------------------------------
Sl_TA42190     KRLRIIKGSEAKGLACL-------------------------------------------
```

FIGURE 14 (continued)

| | |
|---|---|
| AT3G23050.1 | --------------- |
| AT3G23050.2 | --------------- |
| AT4G14550.1 | --------------- |
| Mt_TA20354 | --------------- |
| Pt_566151 | --------------- |
| Pt_720961 | --------------- |
| Sl_TA40922 | --------------- |
| AT1G04250.1 | --------------- |
| Mt_TA27011 | FLFFDKIVIWFVIHI |
| Mt_TA22814 | --------------- |
| Pt_643213 | --------------- |
| Sl_TA48108 | --------------- |
| Os_CB657009 | --------------- |
| Os_TA41733 | --------------- |
| AT3G04730.1 | --------------- |
| Mt_TA20951 | --------------- |
| Mt_TA25400 | --------------- |
| Pt_584053 | --------------- |
| Pt_711734 | --------------- |
| AT4G29080.1 | --------------- |
| Mt_TA23062 | --------------- |
| AT3G23030.1 | --------------- |
| AT4G14560.1 | --------------- |
| Sl_TA38817 | --------------- |
| Sl_TA43058 | --------------- |
| Pt_726443 | --------------- |
| Pt_564913 | --------------- |
| Mt_TA20557 | --------------- |
| Pt_831610 | --------------- |
| Pt_798526 | --------------- |
| Mt_TA31746 | --------------- |
| Pt_823671 | --------------- |
| Pt_595419 | --------------- |
| Mt_TA20558 | --------------- |
| AT1G04240.1 | --------------- |
| Sl_TA42190 | --------------- |

FIGURE 14 (continued)

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2009/062174, filed Sep. 21, 2009, which claims benefit of European application 08165001.2, filed Sep. 24, 2008; U.S. Provisional Application 61/099,629, filed Sep. 24, 2008; U.S. Provisional Application 61/103,301, filed Oct. 7, 2008; European Application 08166008.6, filed Oct. 7, 2008; European Application 08167387.3, filed Oct. 23, 2008; European Application 08167390.7, filed Oct. 23, 2008, U.S. Provisional Application 61/107,680, filed Oct. 23, 2008; U.S. Provisional Application 61/107,695, filed Oct. 23, 2008; European Application 09100261.8, filed Apr. 29, 2009; and U.S. Provisional Application 61/180,953, filed May 26, 2009.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing__13987__00144. The size of the text file is 1,438 KB, and the text file was created on Mar. 19, 2013.

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding an ASPAT (Asparatate AminoTransferase) polypeptide. The present invention also concerns plants having modulated expression of a nucleic acid encoding an ASPAT polypeptide, which plants have enhanced yield-related traits relative to control plants. The invention also provides hitherto unknown ASPAT-encoding nucleic acids and constructs comprising the same, useful in performing the methods of the invention.

Furthermore, the present invention relates generally to the field of molecular biology and concerns a method for increasing various plant yield-related traits by increasing expression in a plant of a nucleic acid sequence encoding a MYB91 like transcription factor (MYB91) polypeptide. The present invention also concerns plants having increased expression of a nucleic acid sequence encoding an MYB91 polypeptide, which plants have increased yield-related traits relative to control plants. The invention additionally relates to nucleic acid sequences, nucleic acid constructs, vectors and plants containing said nucleic acid sequences.

Even furthermore, the present invention relates generally to the field of molecular biology and concerns a method for improving various plant growth characteristics by modulating expression in a plant of a nucleic acid encoding a GASA (Gibberellic Acid-Stimulated *Arabidopsis*). The present invention also concerns plants having modulated expression of a nucleic acid encoding a GASA, which plants have improved growth characteristics relative to corresponding wild type plants or other control plants. The invention also provides constructs useful in the methods of the invention.

Yet furthermore, the present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding an AUX/IAA (auxin/indoleacetic acid) polypeptide. The present invention also concerns plants having modulated expression of a nucleic acid encoding IAA polypeptide, which plants have enhanced yield-related traits relative to control plants. The invention also provides constructs comprising AUX/IAA-encoding nucleic acids, useful in performing the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 Maydica 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

A further important trait is that of improved abiotic stress tolerance. Abiotic stress is a primary cause of crop loss worldwide, reducing average yields for most major crop plants by more than 50% (Wang et al., Planta (2003) 218: 1-14). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defense mechanisms.

Concerning ASPAT polypeptides, it has now been found that various yield-related traits may be improved in plants by modulating expression in a plant of a nucleic acid encoding an ASPAT (Aspartate AminoTransferase) in a plant.

Concerning MYB91 polypeptides, it has now been found that various yield-related traits may be increased in plants relative to control plants, by increasing expression in a plant of a nucleic acid sequence encoding a MYB91 like transcription factor (MYB91) polypeptide. The increased yield-related traits comprise one or more of: increased plant height, increased harvest index (HI), and increased Thousand Kernel Weight (TKW).

Concerning GASA polypeptides, it has now been found that various growth characteristics may be improved in plants by modulating expression in a plant of a nucleic acid encoding a GASA (Gibberellic Acid-Stimulated *Arabidopsis*) in a plant.

Concerning AUX/IAA polypeptides it has now been found that various growth characteristics may be improved in plants by modulating expression in a plant of a nucleic acid encoding an AUX/IAA polypeptide in a plant.

BACKGROUND

1. Aspartate AminoTransferase (ASPAT)

The capacity for growth, development and yield production of a plant is influenced by the regulation of carbon and nitrogen metabolisms and the N/C ratio in a the plant Lawlor 2002 Journal of Experimental Botany, Vol. 53, No. 370, pp. 773-787.

The enzyme Aspartate aminotransferase (ASPAT enzyme) catalyzes catalyses the reversible reaction of transamination between aspartate and 2-oxoglutarate to generate glutamate and oxaloacetate using pyridoxal 5¢-phosphate (PLP) as essential cofactor in a reaction that can be express as: L-aspartate+2-oxoglutarate=oxaloacetate+L-glutamate.

The enzyme plays a key role in the metabolic regulation of carbon and nitrogen metabolism in all organisms. Structurally and functionally the ASPAT enzyme is conserved in all organisms. In eukaryots the enzyme plays a critical role in the interchanges of carbon and nitrogen pools between subcellular compartments.

Aspartate aminotransferases are classified into the group I of the aminotransferase superfamily (Jensen and Gu, 1996). Further, Aspartate Aminotransferases have been classified in four subgroups. Subgroup Ia includes the ASPATs from eubacteria and eukaryotes, whereas subgroup Ib comprises the enzymes from some eubacteria including cyanobacteria and archaebacteria. A new group of ASPAT enzymes was described by De La Torre et al. 2006 Plant J. 2006, 46(3):414-25.

In plants, genes have been identified encoding ASPAT polypeptides that are targeted to different subcellular compartments and assembled into functional ASPAT Isoenzymes in the mitochondria, the cytosol, the peroxisome and the chloroplast.

2. MYB91 Like Transcription Factor (MYB91)

DNA-binding proteins are proteins that comprise any of many DNA-binding domains and thus have a specific or general affinity to DNA. DNA-binding proteins include for example transcription factors that modulate the process of transcription, nucleases that cleave DNA molecules, and histones that are involved in DNA packaging in the cell nucleus.

Transcription factors are usually defined as proteins that show sequence-specific DNA binding affinity and that are capable of activating and/or repressing transcription. The *Arabidopsis thaliana* genome codes for at least 1533 transcriptional regulators, accounting for ~5.9% of its estimated total number of genes (Riechmann et al. (2000) Science 290: 2105-2109). The Database of Rice Transcription Factors (DRTF) is a collection of known and predicted transcription factors of *Oryza sativa* L. ssp. indica and *Oryza sativa* L. ssp. japonica, and currently contains 2,025 putative transcription factors (TF) gene models in indica and 2,384 in japonica, distributed in 63 families (Gao et al. (2006) Bioinformatics 2006, 22(10):1286-7).

One of these families is the MYB domain family of transcription factors, characterized by a highly conserved DNA-binding domain, the MYB domain. The MYB domain was originally described in the oncogene (v-myb) of avian myeloblastosis virus (Klempnauer et al. (1982) Cell 33, 453-63). Many vertebrates contain three genes related to v-Myb c-Myb, A-Myb and B-Myb and other similar genes have been identified in insects, plants, fungi and slime molds. The encoded proteins are crucial to the control of proliferation and differentiation in a number of cell types. MYB proteins contain one to four imperfect direct repeats of a conserved sequence of 50-53 amino acids which encodes a helix-turn-helix structure involved in DNA binding (Rosinski and Atchley (1998) J Mol Evol 46, 74-83). Three regularly spaced tryptophan residues, which form a tryptophan cluster in the three-dimensional helix-turn-helix structure, are characteristic of a MYB repeat. The three repeats in c-Myb are referred to as R1, R2 and R3; and repeats from other MYB proteins are categorised according to their similarity to R1, R2 or R3. Since there is limited sequence conservation outside of the MYB domain, MYB proteins have been clustered into subgroups based on conserved motifs identified outside of the MYB coding region (Jiang et al. (2004) Genome Biology 5, R46).

AtMYB91 belongs to the R2R3-MYB gene family (Li and Parish, Plant J. 8, 963-972, 1995), which is a large gene family (with reportedly 126 genes in *Arabidopsis thaliana* (Zimmerman et al., Plant J. 40, 22-34, 2004)). Members of this group are involved in various processes, including secondary metabolism, cell morphogenesis, regulation of meristem formation, flower and seed development, cell cycle, defense and stress responses, light and hormone signalling (Chen et al., Cell Res. 16, 797-798, 2006). AtMYB91 is also named AS1 asymmetric leaves 1, and is closely related to Antirrhinum PHAN phantastica and to maize ROUGH SHEATH2 (RS2) polypeptides (Sun et al. (2002) Planta 214 (5):694-702), all having an evolutionarily conserved role in specification of leaf cell identity, in particular in dorsal-ventral identity. In *Arabidopsis*, AS1 is expressed in leaf founder cells, where it functions as a heterodimer with the structurally unrelated AS2 proteins to repress activity of KNOTTED 1-like homeobox (KNOX) genes.

3. Gibberellic Acid-Stimulated *Arabidopsis* (GASA)

GASA (Gibberellic Acid-Stimulated *Arabidopsis*) proteins are plant-specific and are expressed during a variety of physiological processes. Several GASA-like genes are hormone responsive, expression of tomato gene GAST1, the first member of the family to be characterized, was induced upon application of exogenous gibberellin in a gibberellin-deficient background (Shi et al. Plant J. 2, 153-159, 1992). A related tomato gene, RSI-1, shares high sequence identity with GAST1 and is activated during lateral root formation (Taylor and Scheuring, Mol. Gen. Genet. 243, 148-157, 1994). GASA1 to GASA4 from *Arabidopsis* were first identified based on their similarity to tomato GAST1 (Herzog et al. Plant Mol. Biol. 27, 743-752, 1995). Expression data indicated that GASA1 accumulates in flower buds and immature siliques, GASA2 and GASA3 in siliques and dry seeds, and GASA4 in growing roots and flower buds. GASA4 is reported to be expressed in all meristematic regions (Aubert et al., Plant Mol. Biol. 36, 871-883, 1998).

Functionally, the GASA proteins are not well characterised. GASA proteins are reportedly involved in pathogen responses and in plant development. Plants ectopically expressing GEG, a GASA homologue from Gerbera hybrida, showed shorter corollas with decreased cell length compared with the wild type, indicating a role for GEG as an inhibitor of cell elongation. Overexpression of *Arabidopsis* GASA4 resulted in plants having increased seed weight (Roxrud et al, Plant Cell Physiol. 48, 471-483, 2007). However, these plants in addition had occasional meristem identity changes with reconversion from floral meristems development to normal indeterminate inflorescence development. Furthermore, modulated GASA4 expression caused a significant increase of branching. Overexpression of *Arabidopsis* GASA4 also increased tolerance to heat stress (Ko et al., Plant Physiol. Biochem. 45, 722-728, 2007).

4. Auxin/Indoleacetic Acid Genes (AUX/IAA)

The AUX/IAA (auxin/indoleacetic acid) genes encode a family of proteins whose expression is tightly regulated by auxin. The plant hormone auxin is involved in various processes like cell division, cell expansion and differentiation, patterning of embryos, vasculature or other tissues, regulation of growth of primary and lateral root or shoot meristems. AUX/IAA proteins furthermore are usually expressed in a tissue-specific manner.

AUX/IAA proteins typically have four conserved amino acid sequence motifs (domains I, II, III and IV) and have nuclear localisation signal sequences. Domains I and II are postulated to destabilize the protein and may be involved in protein turnover. Domains III and IV are postulated to be involved in protein-protein interactions: AUX/IAA proteins can form homodimers and are known to associate with ARF proteins. The AUX/IAA-ARF complexes are likely to be involved in auxin mediated gene expression. The Aux/IAA proteins are negative regulators of the auxin response factors (ARFs) that regulate expression of auxin-responsive genes. Aux/IAA proteins bind to the DNA-bound ARF partner proteins and repress ARF activity. In the auxin activated status, Aux/IAA proteins are ubiquitinated via interactions with the auxin-modified SCFTIR1complex and subsequently degraded by 26S proteasome action. An overview of roles and activities of AUX/IAA proteins is given by Reed (Trends in Plant Science 6, 420-425, 2001). The structure and expression analysis of early auxin-responsive Aux/IAA gene family in rice (*Oryza sativa*) has recently been reported by Jain et al. 2006 Funct Integr Genomics. 2006 January; 6(1):47-59.

IAA14 is a AUX/IAA protein that acts as a transcriptional repressor in lateral root formation. A gain of function mutation in IAA14 blocks early pericycle divisions that initiate lateral root development (Fukaki et al., Plant J. 29, 153-168, 2002).

SUMMARY

1. Aspartate AminoTransferase (ASPAT)

Surprisingly, it has now been found that modulating expression of a nucleic acid encoding an ASPAT polypeptide gives plants having enhanced yield-related traits relative to control plants.

According one embodiment, there is provided a method for enhancing yield-related traits relative to control plants, comprising modulating expression of a nucleic acid encoding an ASPAT polypeptide in a plant.

2. MYB91 Like Transcription Factor (MYB91)

Surprisingly, it has now been found that increasing expression in a plant of a nucleic acid sequence encoding a MYB91 like transcription factor (MYB91) polypeptide as defined herein, gives plants having increased yield-related traits relative to control plants.

According to one embodiment, there is provided a method for increasing yield-related traits in plants relative to control plants, comprising increasing expression in a plant of a nucleic acid sequence encoding a MYB91 like transcription factor (MYB91) as defined herein. The increased yield-related traits comprise one or more of: increased plant height, increased harvest index (HI), and increased Thousand Kernel Weight (TKW).

3. Gibberellic Acid-Stimulated *Arabidopsis* (GASA)

Surprisingly, it has now been found that modulating expression of a nucleic acid encoding a GASA polypeptide gives plants having enhanced yield-related traits, in particular increased yield relative to control plants.

According one embodiment, there is provided a method for improving yield related traits of a plant, relative to control plants, comprising modulating expression of a nucleic acid encoding a GASA polypeptide in a plant.

4. Auxin/Indoleacetic Acid Genes (AUX/IAA)

Surprisingly, it has now been found that modulating expression of a nucleic acid encoding an AUX/IAA polypeptide gives plants having enhanced yield-related traits, in particular increased yield relative to control plants.

According one embodiment, there is provided a method for improving yield related traits of a plant relative to control plants, comprising modulating expression of a nucleic acid encoding an AUX/IAA polypeptide in a plant, wherein the yield related traits do not encompass increased root growth.

DEFINITIONS

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

Motif/Consensus sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin.

The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5°\text{ C.} + 16.6 \times \log_{10}[\text{Na}^+]^a + 0.41 \times \%[G/C^b] - 500 \times [L^c]^{-1} - 0.61 \times \%\text{ formamide}$$

2) DNA-RNA or RNA-RNA hybrids:

$$Tm = 79.8 + 18.5(\log_{10}[\text{Na}^+]^a) + 0.58(\%\ G/C^b) + 11.8(\%\ G/C^b)^2 - 820/L^c$$

3) oligo-DNA or oligo-RNAs hybrids:

For <20 nucleotides: $T_m = 2(I_n)$

For 20-35 nucleotides: $T_m = 22 + 1.46(I_n)$

[a] or for other monovalent cation, but only accurate in the 0.01-0.4 M range.

[b] only accurate for % GC in the 30% to 75% range.

[c] L=length of duplex in base pairs.

[d] oligo, oligonucleotide; $I_n$, =effective length of primer=2×(no. of G/C)+(no. of NT).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 μg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
|---|---|
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
|---|---|
| RCc3 | Plant Mol Biol. 1995 January; 27(2): 237-48 |
| *Arabidopsis* PHT1 | Kovama et al., 2005; Mudge et al. (2002, Plant J. 31: 341) |
| *Medicago* phosphate transporter | Xiao et al., 2006 |
| *Arabidopsis* Pyk10 | Nitz et al. (2001) Plant Sci 161 (2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| *B. napus* G1-3b gene | U.S. Pat. No. 5,401,836 |
| SbPRP1 | Suzuki et al., Plant Mol. Biol. 21: 109-119, 1993. |
| LRX1 | Baumberger et al. 2001, Genes & Dev. 15: 1128 |
| BTG-26 *Brassica napus* | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (*Daucus carota*) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (*Arabidopsis*) | Diener et al. (2001, Plant Cell 13: 1625) |
| NRT2; 1Np (*N. plumbaginifolia*) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

| Examples of seed-specific promoters | |
|---|---|
| Gene source | Reference |
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophos-phorylase | Trans Res 6: 157-68, 1997 |
| maize ESR gene family | Plant J 12: 235-46, 1997 |
| *sorghum* α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d

| examples of endosperm-specific promoters | |
|---|---|
| Gene source | Reference |
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |

TABLE 2d-continued

| examples of endosperm-specific promoters | |
|---|---|
| Gene source | Reference |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| *sorghum* kafirin | DeRose et al. (1996) Plant Mol Biol 32: 1029-35 |

TABLE 2e

| Examples of embryo specific promoters: | |
|---|---|
| Gene source | Reference |
| rice OSH1 | Sato et al, Proc. Natl. Acad. Sci. USA, 93: 8117-8122, 1996 |

TABLE 2e-continued

| Examples of embryo specific promoters: | |
|---|---|
| Gene source | Reference |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

| Examples of aleurone-specific promoters: | |
|---|---|
| Gene source | Reference |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

| Examples of green tissue-specific promoters | | |
|---|---|---|
| Gene | Expression | Reference |
| Maize Orthophosphate dikinase | Leaf specific | Fukavama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

| Examples of meristem-specific promoters | | |
|---|---|---|
| Gene source | Expression pattern | Reference |
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants. Methods for decreasing expression are known in the art and the skilled person would readily be able to adapt the known methods for silencing so as to achieve reduction of expression of an endogenous gene in a whole plant or in parts thereof through the use of an appropriate promoter, for example.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

Examples of various methods for the reduction or substantial elimination of expression in a plant of an endogenous gene, or for lowering levels and/or activity of a protein, are known to the skilled in the art. A skilled person would readily be able to adapt the known methods for silencing, so as to achieve reduction of expression of an endogenous gene in a whole plant or in parts thereof through the use of an appropriate promoter, for example.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. mRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen. Genet. 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol. Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet. 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990)

EMBO J. 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), and g) increased number of primary panicles, which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased seed yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana, Agropyron* spp., *Agrostis stolonifera, Allium* spp., *Amaranthus* spp., *Ammophila arenaria, Ananas comosus, Annona* spp., *Apium graveolens, Arachis* spp, *Artocarpus* spp., *Asparagus officinalis, Avena* spp. (e.g. *Avena sativa, Avena fatua, Avena byzantina, Avena fatua* var. *sativa, Avena hybrida*), *Averrhoa carambola, Bambusa* sp., *Benincasa hispida, Bertholletia excelsea, Beta vulgaris, Brassica* spp. (e.g. *Brassica napus, Brassica rapa* ssp. [canola, oilseed rape, turnip rape]), *Cadaba farinosa, Camellia sinensis, Canna indica, Cannabis sativa, Capsicum* spp., *Carex elata, Carica papaya, Carissa macrocarpa, Carya* spp., *Carthamus tinctorius, Castanea* spp., *Ceiba pentandra, Cichorium endivia, Cinnamomum* spp., *Citrullus lanatus, Citrus* spp., *Cocos* spp., *Coffea* spp., *Colocasia esculenta, Cola* spp., *Corchorus* sp., *Coriandrum sativum, Corylus* spp., *Crataegus* spp., *Crocus sativus, Cucurbita* spp., *Cucumis* spp., *Cynara* spp., *Daucus carota, Desmodium* spp., *Dimocarpus longan, Dioscorea* spp., *Diospyros* spp., *Echinochloa* spp., *Elaeis* (e.g. *Elaeis guineensis, Elaeis oleifera*), *Eleusine coracana, Eragrostis tef, Erianthus* sp., *Eriobotrya japonica, Eucalyptus* sp., *Eugenia uniflora, Fagopyrum* spp., *Fagus* spp., *Festuca arundinacea, Ficus carica, Fortunella* spp., *Fragaria* spp., *Ginkgo biloba, Glycine* spp. (e.g. *Glycine max, Soja hispida* or *Soja max*), *Gossypium hirsutum, Helianthus* spp. (e.g. *Helianthus annuus*), *Hemerocallis fulva, Hibiscus* spp., *Hordeum* spp. (e.g. *Hordeum vulgare*), *Ipomoea batatas, Juglans* spp., *Lactuca sativa, Lathyrus* spp., *Lens culinaris, Linum usitatissimum, Litchi chinensis, Lotus* spp., *Luffa acutangula, Lupinus* spp., *Luzula sylvatica, Lycopersicon* spp. (e.g. *Lycopersicon esculentum, Lycopersicon lycopersicum, Lycopersicon pyriforme*), *Macrotyloma* spp., *Malus* spp., *Malpighia emarginata, Mammea americana, Mangifera indica, Manihot* spp., *Manilkara zapota, Medicago sativa, Melilotus* spp., *Mentha* spp., *Miscanthus sinensis, Momordica* spp., *Morus nigra, Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Panicum virgatum, Passiflora edulis, Pastinaca sativa, Pennisetum* sp., *Persea* spp., *Petroselinum crispum, Phalaris arundinacea, Phaseolus* spp., *Phleum pratense, Phoenix* spp., *Phragmites australis, Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum*

*rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Tripsacum dactyloides, Triticale* sp., *Triticosecale rimpaui, Triticum* spp. (e.g. *Triticum aestivum, Triticum durum, Triticum turgidum, Triticum hybernum, Triticum macha, Triticum sativum, Triticum monococcum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustris, Ziziphus* spp., amongst others.

DETAILED DESCRIPTION OF THE INVENTION

Surprisingly, it has now been found that modulating expression in a plant of a nucleic acid encoding an ASPAT polypeptide gives plants having enhanced yield-related traits relative to control plants. According to a first embodiment, the present invention provides a method for enhancing yield-related traits in plants relative to control plants, comprising modulating expression in a plant of a nucleic acid encoding an ASPAT polypeptide and optionally selecting for plants having enhanced yield-related traits.

Furthermore surprisingly, it has now been found that increasing expression in a plant of a nucleic acid sequence encoding an MYB91 polypeptide as defined herein, gives plants having increased yield-related traits relative to control plants. According to a further embodiment, the present invention provides a method for increasing yield-related traits in plants relative to control plants, comprising increasing expression in a plant of a nucleic acid sequence encoding an MYB91 polypeptide.

Even furthermore surprisingly, it has now been found that modulating expression in a plant of a nucleic acid encoding a GASA polypeptide gives plants having enhanced yield-related traits relative to control plants. According to a further embodiment, the present invention provides a method for enhancing yield-related traits in plants relative to control plants, comprising modulating expression in a plant of a nucleic acid encoding a GASA polypeptide.

Yet furthermore surprisingly, it has now been found that modulating expression in a plant of a nucleic acid encoding an AUX/IAA polypeptide gives plants having enhanced yield-related traits relative to control plants. According to a first embodiment, the present invention provides a method for enhancing yield-related traits in plants relative to control plants, comprising modulating expression in a plant of a nucleic acid encoding an AUX/IAA polypeptide and wherein the yield related traits do not encompass increased root growth.

Concerning ASPAT polypeptides, a preferred method for modulating (preferably, increasing) expression of a nucleic acid encoding an ASPAT polypeptide (ASPAT nucleic acid) is by introducing and expressing in a plant a nucleic acid encoding an ASPAT polypeptide. Preferably the increased expression of the ASPAT nucleic acid and/or the of the ASPAT polypeptide and/or ASPAT activity occurs in one or more subcellular compartments selected in increasing order of preference from the cytosol, the chloroplast, the peroxisomes, the glyoxisomes and the mitochondria of a plant cell.

Cytosolic levels of the ASPAT nucleic acid expression levels and/or ASPAT polypeptide and/or ASPAT activity may be increased for example by expressing an ASPAT nucleic acid encoding a cytosolic isoform. Alternatively, ASPAT nucleic acids encoding isoforms naturally expressed in an organelle of the plant cell may be expressed in the cytosol by removing the specific organelle targeting motifs. Similarly a naturally found cytosolic isoform may be expressed in a preferred organelle by fussing specific acid amino acid motifs encoding known specific subcellular targeting signals of such organelle. Tools and techniques to expresses a polypeptide in a preferred organelle of a plant cell are well known in the art.

Concerning MYB91 polypeptides, a preferred method for increasing expression in a plant of a nucleic acid sequence encoding an MYB91 polypeptide is by introducing and expressing in a plant a nucleic acid sequence encoding an MYB91 polypeptide.

Concerning GASA polypeptides, a preferred method for modulating (preferably, increasing) expression of a nucleic acid encoding a GASA polypeptide is by introducing and expressing in a plant a nucleic acid encoding a GASA polypeptide.

Concerning AUX/IAA polypeptides, a preferred method for modulating (preferably, increasing) expression of a nucleic acid encoding an AUX/IAA polypeptide is by introducing and expressing in a plant a nucleic acid encoding an AUX/IAA polypeptide.

Concerning ASPAT polypeptides, any reference hereinafter to a "protein useful in the methods of the invention" is taken to mean an ASPAT polypeptide as defined herein. Any reference hereinafter to a "nucleic acid useful in the methods of the invention" is taken to mean a nucleic acid capable of encoding such an ASPAT polypeptide. The nucleic acid to be introduced into a plant (and therefore useful in performing the methods of the invention) is any nucleic acid encoding the type of protein which will now be described, hereafter also named "ASPAT nucleic acid" or "ASPAT gene".

Concerning MYB91 polypeptides, any reference hereinafter to a "protein useful in the methods of the invention" is taken to mean an MYB91 polypeptide as defined herein. Any reference hereinafter to a "nucleic acid sequence useful in the methods of the invention" is taken to mean a nucleic acid sequence capable of encoding such an MYB91 polypeptide. The nucleic acid sequence to be introduced into a plant (and therefore useful in performing the methods of the invention) is any nucleic acid sequence encoding the type of polypeptide, which will now be described, hereafter also named "MYB91 nucleic acid sequence" or "MYB91 gene".

Concerning GASA polypeptides, any reference hereinafter to a "protein useful in the methods of the invention" is taken to mean a GASA polypeptide as defined herein. Any reference hereinafter to a "nucleic acid useful in the methods of the invention" is taken to mean a nucleic acid capable of encoding such a GASA polypeptide. The nucleic acid to be introduced into a plant (and therefore useful in performing the methods of the invention) is any nucleic acid encoding the type of protein which will now be described, hereafter also named "GASA nucleic acid" or "GASA gene".

Concerning AUX/IAA polypeptides, any reference hereinafter to a "protein (or polypeptide) useful in the methods of the invention" is taken to mean an AUX/IAA polypeptide as defined herein. Any reference hereinafter to a "nucleic acid useful in the methods of the invention" is taken to mean a nucleic acid capable of encoding such an AUX/IAA polypeptide. The nucleic acid to be introduced into a plant (and therefore useful in performing the methods of the invention) is any nucleic acid encoding the type of protein which will now be described, hereafter also named "AUX/IAA nucleic acid" or "AUX/IAA gene".

An "ASPAT polypeptide" as defined herein refers to any polypeptide comprising an Aminotransferase, class I and II (Aminotran_1_2) domain (Interpro accession number:

IPR004839; pfam accession number: PF00155), and optionally Aspartate Transaminase activity (EC. 2.6.1.1).

Preferably, an ASPAT polypeptide comprises an Aminotran__1__2 domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to any of the Aminotran__1__2 domains as set forth in Tables D1, Table D2 and Table D3.

Preferably the ASPAT polypeptide comprises a motif having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% to any one or more of the following motif:

```
(i)    Motif 1 (SEQ ID NO: 207): NPTG;

(ii)   Motif 2 (SEQ ID NO: 208): IVLLHACAHNPTGVDPT;

(iii)  Motif 3 (SEQ ID NO: 209): SRLLILCSPSNPTGSVY;
```

wherein any amino acid maybe substituted by a conserved amino acid.

Preferably, the homologue of an ASPAT polypeptide has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% overall sequence identity to the amino acid of any of the polypeptides of Table A1, preferably to any of the polypeptides in phylogenetic class 1 of Table B1, more preferably to SEQ ID NO: 2, even more preferably to SEQ ID NO: 8, most preferably to SEQ ID NO: 6. In addition the homologue of an ASPAT protein preferably comprises an Aminotran__1__2 domain as described above. The sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Alternatively, an ASPAT polypeptide useful in the methods of the invention has an amino acid sequence which when used in the construction of a phylogenetic tree, such as the one depicted in FIG. 2 clusters in increasing order of preference with any of the polypeptides of phylogenetic class 1, class 2, class 3 and class 4 as set forth in table B1.

A "MYB91 polypeptide" as defined herein refers to any polypeptide comprising (i) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 269; and (ii) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 270; and (iii) in increasing order of preference at least 50%, 55%, 60%, 65%, 70%, 75%, 80%, 85%, 90%, 95%, 98%, 99% or more amino acid sequence identity to a Conserved Domain as represented by SEQ ID NO: 271.

Alternatively or additionally, a "MYB91 polypeptide" as defined herein refers to any polypeptide sequence having in increasing order of preference at least 50%, 55%, 60%, 65%, 70%, 75%, 80%, 85%, 90%, 95%, 98%, 99% or more amino acid sequence identity to a polypeptide as represented by SEQ ID NO: 221.

Alternatively or additionally, a "MYB91 polypeptide" as defined herein refers to any polypeptide having in increasing order of preference at least 50%, 55%, 60%, 65%, 70%, 75%, 80%, 85%, 90%, 95%, 98%, 99% or more amino acid sequence identity to any of the polypeptide sequences given in Table A2 herein.

Alternatively or additionally, a "MYB91 polypeptide" as defined herein refers to any polypeptide sequence which when used in the construction of a phylogenetic tree of MYB polypeptides, such as the one depicted in FIG. 4, clusters with the MYB91 group of polypeptides rather than with any other group.

A "GASA polypeptide" as defined herein refers to polypeptides comprising in their native form a secretion signal, the GASA domain PF02704 (Interpro IPR003854) and the following three motifs:

```
Motif 4, (SEQ ID NO: 277) comprising 4
conserved Cys residues:
CXXCCXXCX
```

Wherein X in position 2 can be any amino acid, but preferably one of N, K, M, G, L, I, Q; and wherein X in position 3 can be any amino acid, but preferably one of V, T, S, M, I, L, H, Y, K; and wherein X in position 6 can be any amino acid, but preferably one of Q, A, N, D, L, V, R, H, S, G, K, E, T; and wherein X in position 7 can be any amino acid, but preferably one of R, T, A, D, K, E, Q, S, W, C; and wherein X in position 9 can be any amino acid, but preferably one of N, K, R, H, S, G, A, Q, L, D.

```
Motif 5 (SEQ ID NO: 278):
CV(P/L)(P/K/Q/A/S/T)GXX(Q/G/A/S)
```

Wherein X in position 6 can be any amino acid, but preferably one of T, P, S, Y, V, N, F, L; and wherein X in position 7 can be any amino acid, but preferably one of G, Y, F, S, A, L, V.

Motifs 4 and 5 are adjacent to each other or are separated from each other by 1 amino acid.

```
Motif 6 (SEQ ID NO: 279):
CY(D/A/T/F/R/N)X(M/L/W/K)
```

Wherein X in position 4 can be any amino acid, but preferably one of Q, R, S, D, E, N, T, H.

However, the term GASA polypeptide as used in the present invention does not encompass GASA4 from *Arabidopsis thaliana* (SEQ ID NO: 295).

Preferably, the GASA polypeptide useful in the methods of the present invention comprises one or more of the following motifs:

```
Motif 7 (SEQ ID NO: 280):
(S/L/Y/K/S/A)C(G/K/M/I/N/L)(L/M/I/V/T/S)CCXXC

(N/G/A/K/R/H/S/D)
```

Wherein X on position 7 can be any amino acid, but preferably one of E, H, G, K, A, Q, S, R, T, N, D, L, V; and wherein X on position 8 can be any amino acid, but preferably one of E, D, K, Q, S, R, A, T, C.

```
Motif 8 (SEQ ID NO: 281):
CVP(T/S/P/A/K/Q)G(S/P/T)(G/Y/L/A/S/F)(S/A/G/Q)

(T/S/P/N/D)(R/K/T/Y/L/Q/E)(D/S/H/R/E/N)X(C/I)
```

Wherein X in position 12 can be any amino acid, but preferably one of E, H, T, A, S, L, V, K, M.

Preferably, motif 7 is immediately followed by motif 8 or is separated by 1 amino acid from motif 8.

```
Motif 9 (SEQ ID NO: 282):
(P/R/K/T)CY(R/D/T/F/A)(D/Q/R/N/S/T/H/E)(M/K/W/L)

(L/V/K/R/T/N/I)
```

Preferably, motif 8 is immediately followed by motif 9 or is separated by 1 amino acid from motif 9.

```
Motif 10 (SEQ ID NO: 283):
(K/T)(R/P/V/A)C(L/N/M/I)(F/T)(Y/F/L)C(N/L/Q)
(H/Y/K)CC(G/K/E/N/A/R)(W/R/K/T/S/A)C(Q/L/R)CV
(P/L)(P/S/K/A)G(Y/T/V/N/F/L)(V/Y/F)G

Motif 11 (SEQ ID NO: 284):
(N/H)K(G/D/E/Q/A)(C/E/T/S/F/A/V)(C/W)(S/P)CY(N/R)
(N/D)(W/L/M)(K/T/E)(T/K/E/N)(Q/K)

Motif 12 (SEQ ID NO: 285)
(N/R)(G/C)(S/K)(H/Q/A/N/K/G)(K/T)(G/S/Q/A/K)
(H/Y/F)(K/T/R/H)
```

Alternatively, the homologue of a GASA protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 276, provided that the homologous protein comprises the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Preferably, the polypeptide sequence which when used in the construction of a phylogenetic tree, such as the one depicted in FIG. 9, clusters with the group of GASA polypeptides comprising the amino acid sequence represented by SEQ ID NO: 276 (or SEQ ID NO: 291 or SEQ ID NO: 292) rather than with any other group. It should be noted that GASA4 from *Arabidopsis thaliana* (SEQ ID NO: 295) is excluded from the group of GASA proteins as defined in the present invention.

An "AUX/IAA polypeptide" as defined herein refers to any polypeptide comprising an AUX/IAA domain (PFAM accession number PF02309, InterPro entry IPR003311). An "AUX/IAA polypeptide" as defined herein does not comprise the motif represented by SEQ ID NO: 670: (K/N)(I/M/L)F (S/Y)(Q/G)L (IAA2 motif).

AUX/IAA polypeptides of the invention have equivalent amino acid structure and function as the AUX/IAA family of transcription factors and homologues thereof.

The structure and function of AUX/IAA domains are well known in the art. Typically they can be found in AUX/IAA transcription factors of plants. Members of the AUX/IAA family of transcription factors from plant origin are well known in the art. A compilation of AUX/IAA polypeptides as found in the viridiplantae kingdom can be found in dedicated databases such as the so called "plant transcription database (PlnTFDB)" maintained by the university of Postdam (Germany) and described by Riano-Pacho et al. BMC Bioinformatics 2007 8:47.

In the PlnTFDB database the members of the AUX/IAA family are identified as polypeptides having a AUX/IAA domain (PFAM accession number: PF02309) and not having an Auxin_resp domain (pfam accession number: PF06507); Auxin_resp domains are typically found in ARF polypeptides and typically absent from AUX/IAA polypeptides.

An Example of an AUX/IAA domain as found between amino acid coordinates 5-171 of SEQ ID NO: 432. AUX/IAA domains having sequence similarity to the domain as present in SEQ ID NO: 432 are present in the polypeptides of Table A4.

In a one embodiment of the invention, to perform the methods of the invention there is provided a preferred an AUX/IAA polypeptide, also referred to as IAA14-like polypeptide, which comprises an AUX/IAA domain having at least 90%, 91%, 92%, 93%, 94%, 95%, 96%, 97%, 98%, or 99% sequence identity to the amino acid of the AUX/IAA domain represented by the amino acids 1 to 220 in SEQ ID NO: 738 (FIG. 13).

Preferably the IAA14-like polypeptide comprises at least one, and in increasing order of preference, 2, 3, 4, 5, or all six of the following motifs:

```
Motif 13, SEQ ID NO: 739:
(K/R/E/D)(A/E/D)TEL(C/R)LG(L/I)(P/G)

Motif 14, SEQ ID NO: 740:
KRGF(S/A)ET

Motif 15, SEQ ID NO: 741:
VGWPP(V/I)R

Motif 16, SEQ ID NO: 742:
GAPYLRK(V/I)DLXX(Y/F)
```

wherein X on position 11 can be any amino acid, preferably X on position 11 is one of K, T, R, N, S, or Q and wherein X on position 12 can be any amino acid, preferably X on position 12 is one of N, L, T, N, V, I, or C.

```
Motif 17, SEQ ID NO: 743:
(S/N/G)(S/W/T)(E/D/G)(Y/F/H)(V/A/E)(P/L/V/I)
(S/T/A)YEDKD(N/G)D(W/L)M(L/F)(V/I)GDVP
```

-continued

```
Motif 18, SEQ ID NO: 744:
(S/T)C(K/R/Q)(R/K)(L/I)R(I/L)(M/I)K(G/S/E)(S/K/T)
(E/D)(A/T)

Preferably motif 15 is:
VGWPPVR

Motif 16 is preferably:
GAPYLRK(V/I)DL(K/T/R/N)(M/L)Y

Motif 17 is preferably:
(S/N/G)(S/W/T)(E/D)YVP(S/T)YEDKDNDWM(L/F)VGDVP

Motif 18 is preferably:
(S/T)CK(R/K)(L/I)R(I/L)MK(G/S)(S/K/T)EA
```

Preferably the AUX/IAA polypeptide of the invention has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid of an AUX/IAA domain, preferably to the AUX/IAA domain of any of the polypeptides of Table A4, most preferably to the AUX/IAA domain of SEQ ID NO: 432 as represented by the amino acids located between amino acid coordinates 5 to 171.

Preferably, the IAA14-like polypeptide sequence which when used in the construction of a phylogenetic tree, as depicted in FIG. 1 in Remington et al. (Plant Physiol. 135, 1738-1752, 2004), clusters with group A of the IAA14-like polypeptides, which comprises the amino acid sequence represented by SEQ ID NO: 738, rather than with any other group (see also FIG. 15).

Alternatively, the homologue of an AUX/IAA protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides of Table A4 or Table A5 preferably by SEQ ID NO: 432 or SEQ ID NO: 738, provided that the homologous protein comprises one or more of the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

In a preferred embodiment, the polypeptide sequence which when used in the construction of a phylogenetic tree, as depicted in FIG. 1 in Remington et al. (Plant Physiol. 135, 1738-1752, 2004), clusters with group A of the IAA14-like polypeptides, which comprises the amino acid sequence represented by SEQ ID NO: 738, rather than with any other group (see also FIG. 15).

The terms “domain”, “signature” and “motif” are defined in the “definitions” section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Concerning MYB91 polypeptides, an alignment of the polypeptides of Table A2 herein, is shown in FIG. 5. Such alignments are useful for identifying the most conserved domains or motifs between the MYB91 polypeptides as defined herein. Examples of such domains are (i) a MYB DNA binding domain with an InterPro accession number IPR014778, as represented by SEQ ID NO: 269 and/or by SEQ ID NO: 270 (marked by X’s in FIG. 5); and (ii) a MYB DNA transcription factor with an InterPro entry IPR015495 (also marked by X’s in FIG. 2). Another such domain is a C-terminal Conserved Domain as represented by SEQ ID NO: 271, also marked by X’s in FIG. 5.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol. 147(1); 195-7).

Concerning MYB91 polypeptides, example 3 herein describes in Table B the percentage identity between the MYB91 polypeptide as represented by SEQ ID NO: 221 and the MYB91 polypeptides listed in Table A2, which can be as low as 52% amino acid sequence identity. In some instances, the default parameters may be adjusted to modify the stringency of the search. For example using BLAST, the statistical significance threshold (called "expect" value) for reporting matches against database sequences may be increased to show less stringent matches. This way, short nearly exact matches may be identified.

Concerning GASA polypeptides, an alignment can for example be made from the mature protein sequences, that is, without secretion signal peptide. Methods for identifying signal peptides are well known in the art, see for example Bendtsen et al., J. Mol. Biol., 340:783-795 (2004).

The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others. By applying the PSort algorithm to an MYB91 polypeptide as represented by SEQ ID NO: 221, a predicted nuclear subcellular localisation is obtained.

Furthermore, ASPAT polypeptides typically have Aspartate Transaminase also called Aspartate Transferase activity. Tools and techniques for measuring Aspartate Transaminase activity are well known in the art. Aspartate Transaminase activity may be for example assayed in vivo by complementation of *E. coli* strains defective in the activity as described by De la Torre et al. 2006. Alternatively, a biochemical determination of Aspartate Transferase activity may be carried out as for example described in De la Torre et al. 2006.

In addition, ASPAT polypeptides, when expressed in rice according to the methods of the present invention as outlined in the Examples section, give plants having increased yield related traits, in particular increased seed yield.

GASA polypeptides, when expressed in rice according to the methods of the present invention as outlined in the examples section, give plants having increased yield related traits, in particular increased total weight of seeds and/or increased number of filled seeds, and/or increased harvest index.

Furthermore, transgenic plants expressing GASA polypeptides (at least in their native form) may have enhanced tolerance to heat stress (Ko et al, 2007). Tools and techniques for measuring resistance of plants to heat stress are well known in the art, see for example the methods described in Ko et al., 2007.

Furthermore, AUX/IAA polypeptides (at least in their native form) typically have protein binding activity: AUX/IAA polypeptides bind to ARF (Auxin Response Factor) polypeptides. Tools and techniques for measuring protein binding activity are well known in the art and include for example, immuno precipitation of protein complexes and yeast two hybrid. Tools and techniques for measuring the association of AUX/IAA and ARF polypeptide are well known in the art., and include for example yeast two hybrid analysis (see for example Fukaki et al. (Plant J. 44, 382-395, 2005).

Typically AUX/IAA polypeptides of the invention comprise an EAR domain (Ohata et al; Plant Cell. 2001 13(8): 1959-68), which is a well known protein domain that typically confers repression activity to the transcription factors that comprising such domain. The AUX/IAA polypeptides of the invention have preferably transcription repression activity.

Concerning IAA14-like polypeptides, they (at least in their native form) typically associate with ARF7 or ARF19 proteins. Tools and techniques for measuring this association are well known in the art., and include for example yeast two hybrid analysis (see for example Fukaki et al. (Plant J. 44, 382-395, 2005) Further details are provided in the Examples section.

In addition, AUX/IAA polypeptides, when expressed in rice according to the methods of the present invention as outlined in the Examples section, give plants having increased yield related traits selected form increased harvest index, increased root biomass, increased green biomass and increased seed yield.

In addition, AUX/IAA polypeptides, when expressed in rice according to the methods of the present invention as outlined in the Examples section, give plants having increased yield related traits such as increase seed fill rate and increased harvest index.

In addition, IAA14-like polypeptides, when expressed in rice according to the methods of the present invention as outlined in the Examples section, give plants having increased yield related traits, preferably increased seed yield.

Additionally, AUX/IAA polypeptides may display a preferred subcellular localization, typically one or more of nuclear, citoplasmic, chloroplastic, or mitochondrial. The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

Concerning ASPAT polypeptides, the present invention is illustrated by transforming plants with the nucleic acid sequence represented by SEQ ID NO: 1, encoding the polypeptide sequence of SEQ ID NO: 2. However, performance of the invention is not restricted to these sequences; the methods of the invention may advantageously be performed using any ASPAT-encoding nucleic acid or ASPAT polypeptide as defined herein.

Examples of nucleic acids encoding ASPAT polypeptides are given in Table A1 of The Examples section herein. Such nucleic acids are useful in performing the methods of the invention. The amino acid sequences given in Table A1 of The Examples section are example sequences of orthologues and paralogues of the ASPAT polypeptide represented by SEQ ID NO: 2, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A1 of The Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2, the second BLAST would therefore be against rice sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning MYB91 polypeptides, the present invention is illustrated by transforming plants with the nucleic acid sequence represented by SEQ ID NO: 220, encoding the MYB91 polypeptide sequence of SEQ ID NO: 221. However, performance of the invention is not restricted to these sequences; the methods of the invention may advantageously be performed using any nucleic acid sequence encoding an MYB91 polypeptide as defined herein.

Examples of nucleic acid sequences encoding MYB91 polypeptides are given in Table A2 of Example 1 herein. Such nucleic acid sequences are useful in performing the methods of the invention. The polypeptide sequences given in Table A2 of Example 1 are example sequences of orthologues and paralogues of the MYB91 polypeptide represented by SEQ ID NO: 221, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A1 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 220 or SEQ ID NO: 221, the second BLAST would therefore be against *Populus trichocarpa* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning GASA polypeptides, the present invention is illustrated by transforming plants with the nucleic acid sequence represented by SEQ ID NO: 275, encoding the polypeptide sequence of SEQ ID NO: 276; and with SEQ ID NO: 361, encoding SEQ ID NO: 291. However, performance of the invention is not restricted to these sequences; the methods of the invention may advantageously be performed using any GASA-encoding nucleic acid or GASA polypeptide as defined herein. In a preferred embodiment, the nucleic acid encoding the GASA polypeptide, when expressed in a plant, is a heterologous nucleic acid, the heterologous nucleic acid being sufficiently different from the endogenous GASA nucleic acid such that gene silencing is avoided.

Examples of nucleic acids encoding GASA polypeptides are given in Table A3 of the Examples section herein. Such nucleic acids are useful in performing the methods of the invention. The amino acid sequences given in Table A3 of the Examples section are example sequences of orthologues and paralogues of the GASA polypeptide represented by SEQ ID NO: 276, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A3 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 275 or SEQ ID NO: 276, the second BLAST would therefore be against tomato (Solanum lycopersicum) sequences; where the query sequence is SEQ ID NO: 361 or SEQ ID NO: 291, the second BLAST would therefore be against poplar sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning AUX/IAA polypeptides, the present invention is illustrated by transforming plants with the nucleic acid sequence represented by SEQ ID NO: 431 or by SEQ ID NO: 737, encoding the polypeptide sequence of SEQ ID NO: 432 or by SEQ ID NO: 738.

However, performance of the invention is not restricted to these sequences; the methods of the invention may advantageously be performed using any AUX/IAA-encoding nucleic acid or IAA14-like polypeptide as defined herein.

Examples of nucleic acids encoding AUX/IAA polypeptides are given in Table A4 and in Table A5 of the Examples section herein. Such nucleic acids are useful in performing the methods of the invention. The amino acid sequences given in Table A4 and in Table A5 of the Examples section are example sequences of orthologues and paralogues of the AUX/IAA polypeptide represented by SEQ ID NO: 432 or by SEQ ID NO: 738, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A4 or Table A5 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST)

against sequences from the organism from which the query sequence is derived (where the query sequence is SEQ ID NO: 431 or SEQ ID NO: 432, the second BLAST would therefore be against *Arabidopsis* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table A1 to A5 of The Examples section, the terms "homologue" and "derivative" being as defined herein. Also useful in the methods of the invention are nucleic acids encoding homologues and derivatives of orthologues or paralogues of any one of the amino acid sequences given in Table A1 to A5 of The Examples section. Homologues and derivatives useful in the methods of the present invention have substantially the same biological and functional activity as the unmodified protein from which they are derived. Also included are nucleic acids variants in which codon usage is optimised or in which miRNA target sites are removed.

Further nucleic acid variants useful in practising the methods of the invention include portions of nucleic acids encoding ASPAT polypeptides, or MYB91 polypeptides, or GASA polypeptides, or AUX/IAA polypeptides, nucleic acids hybridising to nucleic acids encoding ASPAT polypeptides, or MYB91 polypeptides, or GASA polypeptides, or AUX/IAA polypeptides, splice variants of nucleic acids encoding ASPAT polypeptides, or MYB91 polypeptides, or GASA polypeptides, or AUX/IAA polypeptides, allelic variants of nucleic acids encoding ASPAT polypeptides, or MYB91 polypeptides, or GASA polypeptides, or AUX/IAA polypeptides, and variants of nucleic acids encoding ASPAT polypeptides, or MYB91 polypeptides, or GASA polypeptides, or AUX/IAA polypeptides, obtained by gene shuffling. The terms hybridising sequence, splice variant, allelic variant and gene shuffling are as described herein.

Nucleic acids encoding ASPAT polypeptides, or MYB91 polypeptides, or GASA polypeptides, or AUX/IAA polypeptides, need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A1 to A5 of The Examples section, or a portion of a nucleic acid encoding an orthologue, paralogue or homologue of any of the amino acid sequences given in Table A1 to A5 of The Examples section.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Concerning ASPAT polypeptides, portions useful in the methods of the invention, encode an ASPAT polypeptide as defined herein, and have substantially the same biological activity as the amino acid sequences given in Table A1 of The Examples section. Preferably, the portion is a portion of any one of the nucleic acids given in Table A1 of The Examples section, or is a portion of a nucleic acid encoding an orthologue or paralogue of any one of the amino acid sequences given in Table A1 of The Examples section.

Preferably the portion is at least 100, 200, 300, 400, 500, 550, 600, 650, 700, 750, 800, 850, 900, 950, 1000 consecutive nucleotides in length, the consecutive nucleotides being of any one of the nucleic acid sequences given in Table A1 of The Examples section, or of a nucleic acid encoding an orthologue or paralogue of any one of the amino acid sequences given in Table A1 of The Examples section. Even more preferably the portion is a portion of the nucleic acid of SEQ ID NO: 1, most preferably is the nucleic acid of SEQ ID NO: 3. Preferably, the portion encodes a fragment of an amino acid sequence which, when used in the construction of a phylogenetic tree, such as the one depicted in FIG. 2 clusters in increasing order of preference with any of the polypeptides in phylogenetic class 1, class 2, class 3 and class 4 as set forth in Table B1. Most preferably the portion encodes the amino acid fragment as represented by SEQ ID NO: 4.

Concerning MYB91 polypeptides, portions useful in the methods of the invention, encode an MYB91 polypeptide as defined herein, and have substantially the same biological activity as the polypeptide sequences given in Table A2 of Example 1. Preferably, the portion is a portion of any one of the nucleic acid sequences given in Table A2 of Example 1, or is a portion of a nucleic acid sequence encoding an orthologue or paralogue of any one of the polypeptide sequences given in Table A2 of Example 1. Preferably the portion is, in increasing order of preference at least 500, 550, 600, 650, 700, 750, 800, 850, 900, 950, 1000, 1050 or more consecutive nucleotides in length, the consecutive nucleotides being of any one of the nucleic acid sequences given in Table A2 of Example 1, or of a nucleic acid sequence encoding an orthologue or paralogue of any one of the polypeptide sequences given in Table A2 of Example 1. Preferably, the portion is a portion of a nucleic sequence encoding a polypeptide sequence comprising (i) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 269; and (ii) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 270; and (iii) in increasing order of preference at least 50%, 55%, 60%, 65%, 70%, 75%, 80%, 85%, 90%, 95%, 98%, 99% or more amino acid sequence identity to a Conserved Domain as represented by SEQ ID NO: 271. More preferably, the portion is a portion of a nucleic sequence encoding a polypeptide sequence having in increasing order of preference at least 50%, 55%, 60%, 65%, 70%, 75%, 80%, 85%, 90%, 95%, 98%, 99% or more amino acid sequence identity to the MYB91 polypeptide as represented by SEQ ID NO: 221 or to any of the polypeptide sequences given in Table A2 herein. Most preferably, the portion is a portion of the nucleic acid sequence of SEQ ID NO: 220.

Concerning GASA polypeptides, portions useful in the methods of the invention, encode a GASA polypeptide as defined herein, and have substantially the same biological activity as the amino acid sequences given in Table A3 of the Examples section. Preferably, the portion is a portion of any one of the nucleic acids given in Table A3 of the Examples section, or is a portion of a nucleic acid encoding an orthologue or paralogue of any one of the amino acid sequences given in Table A3 of the Examples section. Preferably the portion is at least 200, 300, 400, 500, 550, 600, 650, 700, 750, 800, 850, 900, 950, 1000 consecutive nucleotides in length, the consecutive nucleotides being of any one of the nucleic acid sequences given in Table A3 of the Examples section, or of a nucleic acid encoding an orthologue or paralogue of any one of the amino acid sequences given in Table A3 of the Examples section. Most preferably the portion is a portion of the nucleic acid of SEQ ID NO: 275. Preferably, the portion encodes a fragment of an amino acid sequence which, when used in the construction of a phylogenetic tree, such as the one depicted in FIG. 9, clusters with the group of GASA polypeptides comprising the amino acid sequence represented by SEQ ID NO: 276 (or SEQ ID NO: 291 or SEQ ID NO: 292) rather than with any other group.

Concerning AUX/IAA polypeptides, portions useful in the methods of the invention, encode an AUX/IAA polypeptide as defined herein, and have substantially the same biological activity as the amino acid sequences given in Table A4 or in Table A5 of the Examples section. Preferably, the portion is a portion of any one of the nucleic acids given in Table A4 or in Table A5 of the Examples section, or is a portion of a nucleic acid encoding an orthologue or paralogue of any one of the amino acid sequences given in Table A4 or in Table A5 of the Examples section. Preferably the portion is at least 100, 200, 300, 400, 500, 550, 600, 650, 700, 750, 800, 850, 900, 950, 1000 consecutive nucleotides in length, the consecutive nucleotides being of any one of the nucleic acid sequences given in Table A4 or in Table A5 of the Examples section, or of a nucleic acid encoding an orthologue or paralogue of any one of the amino acid sequences given in Table A4 or in Table A5 of the Examples section. Most preferably the portion is a portion of the nucleic acid of SEQ ID NO: 431 or of SEQ ID NO: 737. Preferably, the portion encodes a fragment of an amino acid sequence comprising an AUX/IAA domain (PFAM accession number PF2309, InterPro entry IPR003311).

In the case of an IAA14-like polypeptide, preferably, the portion encodes a fragment of an amino acid sequence which, when used in the construction of a phylogenetic tree, as depicted in FIG. 1 in Remington et al. (Plant Physiol. 135, 1738-1752, 2004), clusters with group A of the IAA14-like polypeptides, which comprises the amino acid sequence represented by SEQ ID NO: 738, rather than with any other group (see also FIG. 13).

Another nucleic acid variant useful in the methods of the invention is a nucleic acid capable of hybridising, under reduced stringency conditions, preferably under stringent conditions, with a nucleic acid encoding an ASPAT polypeptide, or an MYB91 polypeptide, or a GASA polypeptide, or an AUX/IAA polypeptide, as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table A1 to A5 of The Examples section, or comprising introducing and expressing in a plant a nucleic acid capable of hybridising to a nucleic acid encoding an orthologue, paralogue or homologue of any of the nucleic acid sequences given in Table A1 to A5 of The Examples section.

Concerning ASPAT polypeptides, hybridising sequences useful in the methods of the invention encode an ASPAT polypeptide as defined herein, having substantially the same biological activity as the amino acid sequences given in Table A1 of The Examples section. Preferably, the hybridising sequence is capable of hybridising to the complement of any one of the nucleic acids given in Table A1 of The Examples section, or to a portion of any of these sequences, a portion being as defined above, or the hybridising sequence is capable of hybridising to the complement of a nucleic acid encoding an orthologue or paralogue of any one of the amino acid sequences given in Table A1 of The Examples section. Even more preferably, the hybridising sequence is capable of hybridising to the complement of a nucleic acid as represented by SEQ ID NO: 1 or to a portion thereof. Most preferably the hybridising sequence is as represented by SEQ ID NO: 3.

Preferably, the hybridising sequence encodes a polypeptide with an amino acid sequence which, when full-length and used in the construction of a phylogenetic tree, such as the one depicted in FIG. 2 clusters in increasing order of preference with any of the polypeptides in phylogenetic class 1, class 2, class 3 and class 4 as set forth in Table B1.

Concerning MYB91 polypeptides, hybridising sequences useful in the methods of the invention encode an MYB91 polypeptide as defined herein, and have substantially the same biological activity as the polypeptide sequences given in Table A2 of Example 1. Preferably, the hybridising sequence is capable of hybridising to any one of the nucleic acid sequences given in Table A2 of Example 1, or to a complement thereof, or to a portion of any of these sequences, a portion being as defined above, or wherein the hybridising sequence is capable of hybridising to a nucleic acid sequence encoding an orthologue or paralogue of any one of the polypeptide sequences given in Table A2 of Example 1, or to a complement thereof. Preferably, the hybridising sequence is capable of hybridising to a nucleic acid sequence encoding a polypeptide sequence comprising (i) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 269; and (ii) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 270; and (iii) in increasing order of preference at least 50%, 55%, 60%, 65%, 70%, 75%, 80%, 85%, 90%, 95%, 98%, 99% or more amino acid sequence identity to a Conserved Domain as represented by SEQ ID NO: 271. More preferably, the hybridising sequence is capable of hybridising to a nucleic acid sequence encoding a polypeptide sequence having in increasing order of preference at least 50%, 55%, 60%, 65%, 70%, 75%, 80%, 85%, 90%, 95%, 98%, 99% or more amino acid sequence identity to the MYB91 polypeptide as represented by SEQ ID NO: 221 or to any of the polypeptide sequences given in Table A2 herein. Most preferably, the hybridising sequence is capable of hybridising to a nucleic acid sequence as represented by SEQ ID NO: 220 or to a portion thereof.

Concerning GASA polypeptides, hybridising sequences useful in the methods of the invention encode a GASA polypeptide as defined herein, having substantially the same biological activity as the amino acid sequences given in Table A3 of the Examples section. Preferably, the hybridising sequence is capable of hybridising to the complement of any one of the nucleic acids given in Table A3 of the Examples section, or to a portion of any of these sequences, a portion being as defined above, or the hybridising sequence is capable of hybridising to the complement of a nucleic acid encoding an orthologue or paralogue of any one of the amino acid sequences given in Table A3 of the Examples section. Most preferably, the hybridising sequence is capable of hybridising to the complement of a nucleic acid as represented by SEQ ID NO: 275 or to a portion thereof.

Preferably, the hybridising sequence encodes a polypeptide with an amino acid sequence which, when full-length and used in the construction of a phylogenetic tree, such as the one depicted in FIG. 9, clusters with the group of GASA polypeptides comprising the amino acid sequence represented by SEQ ID NO: 276 (or SEQ ID NO: 291 or SEQ ID NO: 292) rather than with any other group.

Concerning AUX/IAA polypeptides, hybridising sequences useful in the methods of the invention encode an AUX/IAA polypeptide as defined herein, having substantially the same biological activity as the amino acid sequences given in Table A4 or in Table A5 of the Examples section. Preferably, the hybridising sequence is capable of hybridising to the complement of any one of the nucleic acids given in Table A4 or in Table A5 of the Examples section, or to a portion of any of these sequences, a portion being as defined above, or the hybridising sequence is capable of hybridising to the complement of a nucleic acid encoding an orthologue or paralogue of any one of the amino acid sequences given in Table A4 or in Table A5 of the Examples section. Most preferably, the hybridising sequence is capable of hybridising to the complement of a nucleic acid as represented by SEQ ID NO: 431 or of SEQ ID NO: 737 or to a portion thereof.

Preferably, the hybridising sequence or its complementary sequence encodes a polypeptide with an amino acid sequence comprising an AUX/IAA domain (PFAM accession number PF2309, InterPro entry IPR003311).

In the case IAA14-like polypeptides, preferably, the hybridising sequence encodes a polypeptide with an amino acid sequence which, when full-length and used in the construction of a phylogenetic tree, as depicted in FIG. 1 in Remington et al. (Plant Physiol. 135, 1738-1752, 2004), clusters with group A of the IAA14-like polypeptides, which comprises the amino acid sequence represented by SEQ ID NO: 738, rather than with any other group (see also FIG. 15).

Another nucleic acid variant useful in the methods of the invention is a splice variant encoding an ASPAT polypeptide, or an MYB91 polypeptide, or a GASA polypeptide, or an AUX/IAA polypeptide, as defined hereinabove, a splice variant being as defined herein.

According to the present invention, there is provided a method for enhancing yield-related traits in plants, comprising introducing and expressing in a plant a splice variant of any one of the nucleic acid sequences given in Table A1 to A5 of The Examples section, or a splice variant of a nucleic acid encoding an orthologue, paralogue or homologue of any of the amino acid sequences given in Table A1 to A5 of The Examples section.

Concerning ASPAT polypeptides, preferred splice variants are splice variants of a nucleic acid represented by SEQ ID NO: 1, or a splice variant of a nucleic acid encoding an orthologue or paralogue of SEQ ID NO: 2. Preferably, the amino acid sequence encoded by the splice variant, when used in the construction of a phylogenetic tree, such as the one depicted in FIG. 2 clusters in increasing order of preference with any of the polypeptides in phylogenetic class 1, class 2, class 3 and class 4 as set forth in Table B1.

Concerning MYB91 polypeptides, preferred splice variants are splice variants of a nucleic acid sequence represented by SEQ ID NO: 220, or a splice variant of a nucleic acid sequence encoding an orthologue or paralogue of SEQ ID NO: 221. Preferably, the splice variant is a splice variant of a nucleic acid sequence encoding a polypeptide sequence comprising (i) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 269; and (ii) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 270; and (iii) in increasing order of preference at least 50%, 55%, 60%, 65%, 70%, 75%, 80%, 85%, 90%, 95%, 98%, 99% or more amino acid sequence identity to a Conserved Domain as represented by SEQ ID NO: 271. More preferably, the splice variant is a splice variant of a nucleic acid sequence encoding a polypeptide sequence having in increasing order of preference at least 50%, 55%, 60%, 65%, 70%, 75%, 80%, 85%, 90%, 95%, 98%, 99% or more amino acid sequence identity to the MYB91 polypeptide as represented by SEQ ID NO: 221 or to any of the polypeptide sequences given in Table A2 herein. Most preferably, the splice variant is a splice variant of a nucleic acid sequence as represented by SEQ ID NO: 220, or of a nucleic acid sequence encoding a polypeptide sequence as represented by SEQ ID NO: 221.

Concerning GASA polypeptides, preferred splice variants are splice variants of a nucleic acid represented by SEQ ID NO: 275, or a splice variant of a nucleic acid encoding an orthologue or paralogue of SEQ ID NO: 276. Preferably, the amino acid sequence encoded by the splice variant, when used in the construction of a phylogenetic tree, such as the one depicted in FIG. 93, clusters with the group of GASA polypeptides comprising the amino acid sequence represented by SEQ ID NO: 276 (or SEQ ID NO: 291 or SEQ ID NO: 292) rather than with any other group.

Concerning AUX/IAA polypeptides, preferred splice variants are splice variants of a nucleic acid represented by SEQ ID NO: 431 or of SEQ ID NO: 737, or a splice variant of a nucleic acid encoding an orthologue or paralogue of SEQ ID NO: 432 or of SEQ ID NO: 738.

Preferably, the amino acid sequence encoded by the splice variant comprises an AUX/IAA domain (PFAM accession number PF2309, InterPro entry IPR003311).

In the case of IAA14-like polypeptides, preferably, the amino acid sequence encoded by the splice variant, when used in the construction of a phylogenetic tree, as depicted in FIG. 1 in Remington et al. (Plant Physiol. 135, 1738-1752, 2004), clusters with group A of the IAA14-like polypeptides, which comprises the amino acid sequence represented by SEQ ID NO: 738, rather than with any other group (see also FIG. 15).

Another nucleic acid variant useful in performing the methods of the invention is an allelic variant of a nucleic acid encoding an ASPAT polypeptide, or an MYB91 polypeptide, or a GASA polypeptide, or an AUX/IAA polypeptide, as defined hereinabove, an allelic variant being as defined herein.

According to the present invention, there is provided a method for enhancing yield-related traits in plants, comprising introducing and expressing in a plant an allelic variant of any one of the nucleic acids given in Table A1 to A5 of The Examples section, or comprising introducing and expressing in a plant an allelic variant of a nucleic acid encoding an orthologue, paralogue or homologue of any of the amino acid sequences given in Table A1 to A5 of The Examples section.

Concerning ASPAT polypeptides, the polypeptides encoded by allelic variants useful in the methods of the present invention have substantially the same biological activity as the ASPAT polypeptide of SEQ ID NO: 2 and any of the amino acids depicted in Table A1 of The Examples section. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2. Preferably, the amino acid sequence encoded by the allelic variant, when used in the construction of a phylogenetic tree, such as the one depicted in FIG. 2 clusters in increasing order of preference with any of the polypeptides in phylogenetic class 1, class 2, class 3 and class 4 as set forth in Table B1.

Concerning MYB91 polypeptides, the allelic variants useful in the methods of the present invention have substantially the same biological activity as the MYB91 polypeptide of SEQ ID NO: 221 and any of the polypeptide sequences depicted in Table A2 of Example 1. Allelic variants exist in nature, and encompassed within the methods of the present invention is the use of these natural alleles. Preferably, the allelic variant is an allelic variant of a polypeptide sequence comprising (i) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 269; and (ii) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 270; and (iii) in increasing order of preference at least 50%, 55%, 60%, 65%, 70%, 75%, 80%, 85%, 90%, 95%, 98%, 99% or more amino acid sequence identity to a Conserved Domain as represented by SEQ ID NO: 271. More preferably the allelic variant is an allelic variant encoding a polypeptide sequence having in increasing order of preference at least 50%, 55%, 60%, 65%, 70%, 75%, 80%, 85%, 90%, 95%, 98%, 99% or more amino acid sequence identity to the MYB91 polypeptide as represented by SEQ ID NO: 221 or to any of the polypeptide sequences given in Table A2 herein. Most preferably, the allelic variant is an allelic variant of SEQ ID NO: 220 or an allelic variant of a nucleic acid sequence encoding an orthologue or paralogue of SEQ ID NO: 221.

Concerning GASA polypeptides, the polypeptides encoded by allelic variants useful in the methods of the present invention have substantially the same biological activity as the GASA polypeptide of SEQ ID NO: 276 and any of the amino acids depicted in Table A3 of the Examples section. Allelic variants exist in nature, and encompassed within the methods of the present invention is the use of these natural alleles. Preferably, the allelic variant is an allelic variant of SEQ ID NO: 275 or an allelic variant of a nucleic acid encoding an orthologue or paralogue of SEQ ID NO: 276. Preferably, the amino acid sequence encoded by the allelic variant, when used in the construction of a phylogenetic tree, such as the one depicted in FIG. 9, clusters with the group of GASA polypeptides comprising the amino acid sequence represented by SEQ ID NO: 276 (or SEQ ID NO: 291 or SEQ ID NO: 292) rather than with any other group.

Concerning AUX/IAA polypeptides, the polypeptides encoded by allelic variants useful in the methods of the present invention have substantially the same biological activity as the AUX/IAA polypeptide of SEQ ID NO: 432 or of SEQ ID NO: 738 and any of the amino acids depicted in Table A4 or in Table A5 of the Examples section. Allelic variants exist in nature, and encompassed within the methods of the present invention is the use of these natural alleles. Preferably, the allelic variant is an allelic variant of SEQ ID NO: 431 or of SEQ ID NO: 737 or an allelic variant of a nucleic acid encoding an orthologue or paralogue of SEQ ID NO: 432 or of SEQ ID NO: 738. Preferably, the amino acid sequence encoded by the allelic variant comprises an AUX/IAA domain (PFAM accession number PF2309, InterPro entry IPR003311). In the case of IAA14-like, preferably, the amino acid sequence encoded by the allelic variant, when used in the construction of a phylogenetic tree, as depicted in FIG. 1 in Remington et al. (Plant Physiol. 135, 1738-1752, 2004), clusters with group A of the IAA14-like polypeptides, which comprises the amino acid sequence represented by SEQ ID NO: 738, rather than with any other group (see also FIG. 15).

Gene shuffling or directed evolution may also be used to generate variants of nucleic acids encoding ASPAT polypeptides, or MYB91 polypeptides, GASA polypeptides, AUX/IAA polypeptides, or as defined above; the term "gene shuffling" being as defined herein.

According to the present invention, there is provided a method for enhancing yield-related traits in plants, comprising introducing and expressing in a plant a variant of any one of the nucleic acid sequences given in Table A1 to A5 of The Examples section, or comprising introducing and expressing in a plant a variant of a nucleic acid encoding an orthologue, paralogue or homologue of any of the amino acid sequences given in Table A1 to A5 of The Examples section, which variant nucleic acid is obtained by gene shuffling.

Concerning ASPAT polypeptides, preferably, the amino acid sequence encoded by the variant nucleic acid obtained by gene shuffling, when used in the construction of a phylogenetic tree such as the one depicted in FIG. 2 clusters in increasing order of preference with any of the polypeptides in phylogenetic class 1, class 2, class 3 and class 4 as set forth in Table B1.

Concerning MYB91 polypeptides, preferably, the variant nucleic acid sequence obtained by gene shuffling encodes a polypeptide sequence comprising (i) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 269; and (ii) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 270; and (iii) in increasing order of preference at least 50%, 55%, 60%, 65%, 70%, 75%, 80%, 85%, 90%, 95%, 98%, 99% or more amino acid sequence identity to a Conserved Domain as represented by SEQ ID NO: 271. More preferably, the variant nucleic acid sequence obtained by gene shuffling encodes a polypeptide sequence having in increasing order of preference at least 50%, 55%, 60%, 65%, 70%, 75%, 80%, 85%, 90%, 95%, 98%, 99% or more amino acid sequence identity to the MYB91 polypeptide as represented by SEQ ID NO: 221 or to any of the polypeptide sequences given in Table A1 herein. Most preferably, the nucleic acid sequence obtained by gene shuffling encodes a polypeptide sequence as represented by SEQ ID NO: 221.

Concerning GASA polypeptides, preferably, the amino acid sequence encoded by the variant nucleic acid obtained by gene shuffling, when used in the construction of a phylogenetic tree such as the one depicted in FIG. 9, clusters with the group of GASA polypeptides comprising the amino acid sequence represented by SEQ ID NO: 276 (or SEQ ID NO: 291 or SEQ ID NO: 292) rather than with any other group.

In the case of IAA14-like polypeptides, preferably, the amino acid sequence encoded by the variant nucleic acid obtained by gene shuffling, when used in the construction of a phylogenetic tree, as depicted in FIG. 1 in Remington et al. (Plant Physiol. 135, 1738-1752, 2004), clusters with group A of the IAA14-like polypeptides, which comprises the amino acid sequence represented by SEQ ID NO: 738, rather than with any other group (see also FIG. 15).

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding ASPAT polypeptides may be derived from any natural or artificial source. The nucleic acid may be modified from its native form in composition and/or genomic environment through deliberate human manipulation. Preferably the ASPAT polypeptide-encoding nucleic acid is from a plant, further preferably from a monocotyledonous plant, more preferably from the family Poaceae, most preferably the nucleic acid is from *Oryza sativa*.

Advantageously, the invention also provides hitherto unknown ASPAT-encoding nucleic acids and ASPAT polypeptides.

According to a further embodiment of the present invention, there is therefore provided an isolated nucleic acid molecule selected from:

(i) a nucleic acid represented by any one of SEQ ID NO: 81, 147, 153, 183 and 185;

(ii) the complement of a nucleic acid represented by any one of SEQ ID NO: 81, 147, 153, 183 and 185;

(iii) a nucleic acid encoding the polypeptide as represented by any one of SEQ ID NO: 82, 148, 154, 184 and 186, preferably as a result of the degeneracy of the genetic code, said isolated nucleic acid can be derived from a polypeptide sequence as represented by any one of SEQ ID NO: 82, 148, 154, 184 and 186 and further preferably confers enhanced yield-related traits relative to control plants;

(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A1 and further preferably conferring enhanced yield-related traits relative to control plants;

(v) a nucleic acid molecule which hybridizes with a nucleic acid molecule of (i) to (iv) under stringent hybridization conditions and preferably confers enhanced yield-related traits relative to control plants;

(vi) a nucleic acid encoding an ASPAT polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 82, 148, 154, 184 and 186 and any of the other amino acid sequences in Table A1 and preferably conferring enhanced yield-related traits relative to control plants.

According to a further embodiment of the present invention, there is also provided an isolated polypeptide selected from:

(i) an amino acid sequence represented by any one of SEQ ID NO: 82, 148, 154, 184 and 186;

(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 82, 148, 154, 184 and 186, and any of the other amino acid sequences in Table A1 and preferably conferring enhanced yield-related traits relative to control plants.

(iii) derivatives of any of the amino acid sequences given in (i) or (ii) above.

Nucleic acid sequences encoding MYB91 polypeptides may be derived from any natural or artificial source. The nucleic acid sequence may be modified from its native form in composition and/or genomic environment through deliberate human manipulation. The nucleic acid sequence encoding an MYB91 polypeptide is from a plant, further preferably from a dicotyledonous plant, more preferably from the family Salicaceae, most preferably the nucleic acid sequence is from *Populus trichocarpa*.

Nucleic acids encoding GASA polypeptides may be derived from any natural or artificial source. The nucleic acid may be modified from its native form in composition and/or genomic environment through deliberate human manipulation. Preferably the GASA polypeptide-encoding nucleic acid is from a plant, further preferably from a dicotyledonous plant, more preferably from the family Solanaceae, most preferably the nucleic acid is from *Solanum lycopersicum*. Alternatively, the GASA polypeptide-encoding nucleic acid is from the family Salicaceae, preferably from *Populus* sp.

Nucleic acids encoding AUX/IAA polypeptides may be derived from any natural or artificial source. The nucleic acid may be modified from its native form in composition and/or genomic environment through deliberate human manipulation. Preferably the IAA14-like polypeptide-encoding nucleic acid is from a plant, further preferably from a monocotyledonous or a dicotyledonous plan, more preferably from the family Poaceae or Brassicaceae, most preferably the nucleic acid is from *Oryza sativa* or from *Arabidopsis thaliana*.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants. Concerning GASA polypeptides, It should be noted that the plants with modulated expression of a nucleic acid encoding a GASA polypeptide according to the methods of this invention did not show significant changes in branching properties compared to the control plants.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression in a plant of a nucleic acid encoding an ASPAT polypeptide, or a GASA polypeptide, or an AUX/IAA polypeptide, as defined herein.

The present invention also provides a method for increasing yield-related traits of plants relative to control plants, which method comprises increasing expression in a plant of a nucleic acid sequence encoding an MYB91 polypeptide as defined herein.

Since the transgenic plants according to the present invention have increased yield and/or increased yield-related traits, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect increased (early) vigour. The increase in growth rate may alter the harvest cycle of a plant allowing plants to be sown later and/or harvested sooner than would otherwise be possible (a similar effect may be obtained with earlier flowering time; delayed flowering is usually not a desired trait in crops). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding an ASPAT polypeptide, or an MYB91 polypeptide, or a GASA polypeptide, or an AUX/IAA polypeptide, as defined herein.

Increased yield-related traits occur whether the plant is under non-stress conditions or whether the plant is exposed to various stresses compared to control plants grown under comparable conditions. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, and/or pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes, and insects. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild stress conditions having increased yield-related traits, relative to control plants grown under comparable conditions. Therefore, according to the present invention, there is provided a method for increasing yield-related traits in plants grown under non-stress conditions or under mild stress conditions, which method comprises increasing expression in a plant of a nucleic acid sequence encoding an MYB91 polypeptide.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% of the average production of such plant in a given environment. Average production may be calculated on harvest and/or season basis. Persons skilled in the art are aware of average yield productions of a crop.

Performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding an ASPAT polypeptide, or an MYB91 polypeptide, or a GASA polypeptide, or an AUX/IAA polypeptide.

The term "abiotic stress" as defined herein is taken to mean any one or more of: water stress (due to drought or excess water), anaerobic stress, salt stress, temperature stress (due to hot, cold or freezing temperatures), chemical toxicity stress and oxidative stress. According to one aspect of the invention, the abiotic stress is an osmotic stress, selected from water stress, salt stress, oxidative stress and ionic stress. Preferably, the water stress is drought stress. The term salt stress is not restricted to common salt (NaCl), but may be any stress caused by one or more of: NaCl, KCl, LiCl, $MgCl_2$, $CaCl_2$, amongst others.

Performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding an ASPAT polypeptide, or a GASA polypeptide, or an AUX/IAA polypeptide. The term salt stress is not restricted to common salt (NaCl), but may be any one or more of: NaCl, KCl, LiCl, $MgCl_2$, $CaCl_2$, amongst others.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with increased yield-related traits, when grown under nitrogen-limiting conditions.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding an ASPAT polypeptide, or a GASA polypeptide, or an AUX/IAA polypeptide. Nutrient deficiency may result from a lack of nutrients such as nitrogen, phosphates and other phosphorous-containing compounds, potassium, calcium, cadmium, magnesium, manganese, iron and boron, amongst others.

Performance of the methods of the invention gives plants grown under conditions of reduced nutrient availability, particularly under conditions of reduced nitrogen availability, having increased yield-related traits relative to control plants grown under comparable conditions. Therefore, according to the present invention, there is provided a method for increasing yield-related traits in plants grown under conditions of reduced nutrient availability, preferably reduced nitrogen availability, which method comprises increasing expression in a plant of a nucleic acid sequence encoding an MYB91 polypeptide. Reduced nutrient availability may result from a deficiency or excess of nutrients such as nitrogen, phosphates and other phosphorous-containing compounds, potassium, calcium, cadmium, magnesium, manganese, iron and boron, amongst others. Preferably, reduced nutrient availability is reduced nitrogen availability.

Performance of the methods of the invention gives plants having increased yield-related traits, under abiotic stress conditions relative to control plants grown in comparable stress conditions. Therefore, according to the present invention, there is provided a method for increasing yield-related traits, in plants grown under abiotic stress conditions, which method comprises increasing expression in a plant of a nucleic acid sequence encoding an MYB91 polypeptide. According to one aspect of the invention, the abiotic stress is an osmotic stress, selected from one or more of the following: water stress, salt stress, oxidative stress and ionic stress.

The present invention encompasses plants or parts thereof (including seeds) or cells thereof obtainable by the methods according to the present invention. The plants or parts thereof comprise a nucleic acid transgene encoding an ASPAT polypeptide, or an MYB91 polypeptide, or a GASA polypeptide, or an AUX/IAA polypeptide, as defined above, operably linked to a promoter functioning in plants.

The invention also provides genetic constructs and vectors to facilitate introduction and/or expression in plants of nucleic acids encoding ASPAT polypeptides, or MYB91 polypeptides, or GASA polypeptides, or AUX/IAA polypeptides, as defined herein. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:

(a) a nucleic acid encoding an ASPAT polypeptide, or an MYB91 polypeptide, or a GASA polypeptide, or an AUX/IAA polypeptide, as defined above;

(b) one or more control sequences capable of driving expression of the nucleic acid sequence of (a); and optionally (c) a transcription termination sequence.

Preferably, the nucleic acid encoding is an ASPAT polypeptide, or an MYB91 polypeptide, or a GASA polypeptide, or an AUX/IAA polypeptide, as defined above. The term "control sequence" and "termination sequence" are as defined herein.

Concerning MYB91 polypeptides, preferably, one of the control sequences of a construct is a constitutive promoter isolated from a plant genome. An example of a constitutive promoter is a GOS2 promoter, preferably a GOS2 promoter from rice, most preferably a GOS2 sequence as represented by SEQ ID NO: 272.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to drive expression of the nucleic acid sequence, but preferably the promoter is of plant origin. A constitutive promoter is particularly useful in the methods. Preferably the constitutive promoter is also a ubiquitous promoter of medium strength. See the "Definitions" section herein for definitions of the various promoter types. Concerning ASPAT polypeptides, also useful in the methods of the invention is a green tissue-specific promoter.

Concerning MYB91 polypeptides, advantageously, any type of promoter, whether natural or synthetic, may be used to increase expression of the nucleic acid sequence. A constitutive promoter is particularly useful in the methods, preferably a constitutive promoter isolated from a plant genome. The plant constitutive promoter drives expression of a coding sequence at a level that is in all instances below that obtained under the control of a 35S CaMV viral promoter. An example of such a promoter is a GOS2 promoter as represented by SEQ ID NO: 272.

Concerning MYB91 polypeptides, organ-specific promoters, for example for preferred expression in leaves, stems, tubers, meristems, seeds, are useful in performing the methods of the invention. Developmentally-regulated and inducible promoters are also useful in performing the methods of the invention. See the "Definitions" section herein for definitions of the various promoter types.

Concerning ASPAT polypeptides, it should be clear that the applicability of the present invention is not restricted to the ASPAT polypeptide-encoding nucleic acid represented by SEQ ID NO: 1, nor is the applicability of the invention restricted to expression of an ASPAT polypeptide-encoding nucleic acid when driven by a constitutive promoter, or when driven by a green tissue-specific promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 218, most preferably the constitutive promoter is as represented by SEQ ID NO: 218. See the "Definitions" section herein for further examples of constitutive promoters.

According to another preferred feature of the invention, the nucleic acid encoding an ASPAT polypeptide is operably linked to a green tissue-specific promoter. The green tissue-specific promoter is preferably a promoter of the a Protochlorophyllide reductase (PR) gene, more preferably the PR promoter is from rice, further preferably the PR promoter is represented by a nucleic acid sequence substantially similar to SEQ ID NO: 219, most preferably the promoter is as represented by SEQ ID NO: 219. Examples of other green tissue-specific promoters which may also be used to perform the methods of the invention are shown in Table 3 in the "Definitions" section above.

Concerning MYB91 polypeptides, it should be clear that the applicability of the present invention is not restricted to a nucleic acid sequence encoding the MYB91 polypeptide, as represented by SEQ ID NO: 220, nor is the applicability of the invention restricted to expression of an MYB91 polypeptide-encoding nucleic acid sequence when driven by a constitutive promoter.

Concerning GASA polypeptides, it should be clear that the applicability of the present invention is not restricted to the GASA polypeptide-encoding nucleic acid represented by SEQ ID NO: 275 or SEQ ID NO: 361, nor is the applicability of the invention restricted to expression of a GASA polypeptide-encoding nucleic acid when driven by a constitutive promoter.

The constitutive promoter is preferably a medium strength promoter, more preferably selected from a plant derived promoter, such as a GOS2 promoter, more preferably is the promoter a GOS2 promoter from rice. Further preferably the constitutive promoter is represented by a nucleic acid sequence substantially similar to SEQ ID NO: 290, most preferably the constitutive promoter is as represented by SEQ ID NO: 290. See the "Definitions" section herein for further examples of constitutive promoters.

Optionally, one or more terminator sequences may be used in the construct introduced into a plant. Preferably, the construct comprises an expression cassette comprising a GOS2 promoter and the nucleic acid encoding the GASA polypeptide.

Concerning AUX/IAA polypeptides, it should be clear that the applicability of the present invention is not restricted to the AUX/IAA polypeptide-encoding nucleic acid represented by SEQ ID NO: 431 or by SEQ ID NO: 737, nor is the applicability of the invention restricted to expression of an AUX/IAA polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 669, most preferably the constitutive promoter is as represented by SEQ ID NO: 669. See the "Definitions" section herein for further examples of constitutive promoters.

Alternatively, the constitutive promoter is preferably a weak constitutive promoter, more preferably selected from a plant derived promoter, such as a High Mobility Group Protein (HMGP) promoter, more preferably is the promoter HMGP promoter from rice. Further preferably the constitutive promoter is represented by a nucleic acid sequence substantially similar to SEQ ID NO: 747, most preferably the constitutive promoter is as represented by SEQ ID NO: 747. See the "Definitions" section herein for further examples of constitutive promoters.

Optionally, one or more terminator sequences may be used in the construct introduced into a plant. Preferably, the construct comprises an expression cassette comprising a GOS2 or a HMGP promoter, substantially similar to SEQ ID NO: 669 or to SEQ ID NO: 747 respectively, and the nucleic acid encoding the AUX/IAA polypeptide.

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

It is known that upon stable or transient integration of nucleic acid sequences into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid sequence molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid sequence can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

The invention also provides a method for the production of transgenic plants having enhanced yield-related traits relative to control plants, comprising introduction and expression in a plant of any nucleic acid encoding an ASPAT polypeptide, or an MYB91 polypeptide, or a GASA polypeptide, or an AUX/IAA polypeptide, as defined hereinabove.

More specifically, the present invention provides a method for the production of transgenic plants having enhanced yield-related traits, particularly increased seed yield, which method comprises:

(i) introducing and expressing in a plant, plant part, or plant cell a nucleic acid encoding an ASPAT polypeptide, or an MYB91 polypeptide, or a GASA polypeptide, or an AUX/IAA polypeptide; and (ii) cultivating the plant cell under conditions promoting plant growth and development.

The nucleic acid of (i) may be any of the nucleic acids capable of encoding an ASPAT polypeptide, or an MYB91 polypeptide, or a GASA polypeptide, or an AUX/IAA polypeptide, as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the above-mentioned publications by S. D. Kung and R. Wu, Potrykus or Hofgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding an ASPAT polypeptide, or an MYB91 polypeptide, or a GASA polypeptide, or an AUX/IAA polypeptide, as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, sorghum, emmer, spelt, *secale*, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding an ASPAT polypeptide, or an MYB91 polypeptide, or a GASA polypeptide, or an AUX/IAA polypeptide. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding an ASPAT polypeptide, or an MYB91 polypeptide, or a GASA polypeptide, or an AUX/IAA polypeptide, is by introducing and expressing in a plant a nucleic acid encoding an ASPAT polypeptide, or an MYB91 polypeptide, or a GASA polypeptide, or an AUX/IAA polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The present invention also encompasses use of nucleic acids encoding ASPAT polypeptides, or GASA polypeptides, or AUX/IAA polypeptides, as described herein and use of these ASPAT polypeptides, or GASA polypeptides, or AUX/IAA polypeptides, in enhancing any of the aforementioned yield-related traits in plants.

The present invention also encompasses use of nucleic acid sequences encoding MYB91 polypeptides as described herein and use of these MYB91 polypeptides in increasing any of the aforementioned yield-related traits in plants, under normal growth conditions, under abiotic stress growth (preferably osmotic stress growth conditions) conditions, and under growth conditions of reduced nutrient availability, preferably under conditions of reduced nitrogen availability.

Nucleic acids encoding an ASPAT polypeptide, or an MYB91 polypeptide, or a GASA polypeptide, or an AUX/IAA polypeptide, described herein, or the ASPAT polypeptides, or MYB91 polypeptides, or GASA polypeptides, or AUX/IAA polypeptides, themselves, may find use in breeding programmes in which a DNA marker is identified which may be genetically linked to a gene encoding an ASPAT polypeptide, or an MYB91 polypeptide, or a GASA polypeptide, or an AUX/IAA polypeptide. The nucleic acids/genes, or the ASPAT polypeptides themselves may be used to define a molecular marker. This DNA or protein marker may then be used in breeding programmes to select plants having enhanced yield-related traits as defined hereinabove in the methods of the invention.

Allelic variants of a nucleic acid/gene encoding an ASPAT polypeptide, or an MYB91 polypeptide, or a GASA polypeptide, or an AUX/IAA polypeptide may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield and/or yield-related traits. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding ASPAT polypeptides, or MYB91 polypeptides, or GASA polypeptides, or AUX/IAA polypeptides, may also be used as probes for genetically and physically mapping the genes that they are a part of, and as markers for traits linked to those genes. Such information may be useful in plant breeding in order to develop lines with desired phenotypes. Such use of nucleic acids encoding an ASPAT polypeptide, or an MYB91 polypeptide, or a GASA polypeptide, or an AUX/IAA polypeptide, requires only a nucleic acid sequence of at least 15 nucleotides in length. The encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the encoding nucleic acids encoding an ASPAT polypeptide, or an MYB91 polypeptide, or a GASA polypeptide, or an AUX/IAA polypeptide. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding an ASPAT polypeptide, or an MYB91 polypeptide, or a GASA polypeptide, or an AUX/IAA polypeptide, in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

Concerning ASPAT polypeptides, concerning GASA polypeptides, or an AUX/IAA polypeptide, the methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

Concerning MYB91 polypeptides, the methods according to the present invention result in plants having increased yield-related traits, as described hereinbefore. These traits may also be combined with other economically advantageous traits, such as further yield-increasing traits, tolerance to abiotic and biotic stresses, tolerance to herbicides, insecticides, traits modifying various architectural features and/or biochemical and/or physiological features.

Items

1. Aspartate AminoTransferase (ASPAT)

1. A method for enhancing yield-related traits in plants relative to control plants, comprising modulating expression in a plant of a nucleic acid encoding an ASPAT (Aspartate Aminotransferase) polypeptide comprising an Aminotransferase class I and II (Aminotran_1_2) domain (Interpro accession number: IPR004839; pfam accession number: PF00155), and optionally selecting plants having enhanced yield-related traits
2. Method according to item 1, wherein said ASPAT polypeptide comprising one or more of the following motifs having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% to any one or more of the following motif:

```
(i)
Motif 1: NPTG,                       (SEQ ID NO: 207)

(ii)
Motif 2: IVLLHACAHNPTGVDPT,          (SEQ ID NO: 208)

(iii)
Motif 3: SRLLILCSPSNPTGSVY           (SEQ ID NO: 209)
```

wherein any amino acid residue maybe substituted by a conserved amino acid.

3. Method according to item 1 or 2, wherein said modulated expression is effected by introducing and expressing in a plant a nucleic acid encoding an ASPAT polypeptide.
4. Method according to any one of items 1 to 3, wherein said nucleic acid encoding an ASPAT polypeptide encodes any one of the proteins listed in Table A or is a portion of such a nucleic acid, or a nucleic acid capable of hybridising with such a nucleic acid.
5. Method according to any one of items 1 to 4, wherein said nucleic acid sequence encodes an orthologue or paralogue of any of the proteins given in Table A1.
6. Method according to any preceding item, wherein said enhanced yield-related traits comprise increased yield, preferably increased biomass and/or increased seed yield relative to control plants.
7. Method according to any one of items 1 to 6, wherein said enhanced yield-related traits are obtained under non-stress conditions.
8. Method according to any one of items 1 to 6, wherein said enhanced yield-related traits are obtained under conditions of drought stress, salt stress or nitrogen deficiency.

9. Method according to any one of items 3 to 8, wherein said nucleic acid is operably linked to a constitutive promoter, preferably to a GOS2 promoter, most preferably to a GOS2 promoter from rice.
10. Method according to any one of items 3 to 8, wherein said nucleic acid is operably linked to a green tissue-specific promoter, preferably to a PR promoter, most preferably to a PR promoter from rice.
11. Method according to any one of items 1 to 10, wherein said nucleic acid encoding an ASPAT polypeptide is of plant origin, preferably from a dicotyledonous plant, further preferably from the family poaceae, more preferably from the genus *Oryza*, most preferably from *Oryza sativa*.
12. Plant or part thereof, including seeds, obtainable by a method according to any one of items 1 to 11, wherein said plant or part thereof comprises a recombinant nucleic acid encoding an ASPAT polypeptide.
13. Construct comprising:
   (i) nucleic acid encoding an ASPAT polypeptide as defined in items 1 or 2;
   (ii) one or more control sequences capable of driving expression of the nucleic acid sequence of (a); and optionally
   (iii) a transcription termination sequence.
14. Construct according to item 13, wherein one of said control sequences is a constitutive promoter, preferably a GOS2 promoter, most preferably a GOS2 promoter from rice.
15. Construct according to item 13, wherein one of said control sequences is a green tissue-specific promoter, preferably to a PR promoter, most preferably to a PR promoter from rice.
16. Use of a construct according to item 13 to 15 in a method for making plants having increased yield, particularly increased biomass and/or increased seed yield relative to control plants.
17. Plant, plant part or plant cell transformed with a construct according to item 13 to 15.
18. Method for the production of a transgenic plant having increased yield, particularly increased biomass and/or increased seed yield relative to control plants, comprising:
   (i) introducing and expressing in a plant a nucleic acid encoding an ASPAT polypeptide as defined in item 1 or 2; and
   (ii) cultivating the plant cell under conditions promoting plant growth and development.
19. Transgenic plant having increased yield, particularly increased biomass and/or increased seed yield, relative to control plants, resulting from modulated expression of a nucleic acid encoding an ASPAT polypeptide as defined in item 1 or 2, or a transgenic plant cell derived from said transgenic plant.
20. Transgenic plant according to item 11, 17 or 18, or a transgenic plant cell derived thereof, wherein said plant is a crop plant or a monocot or a cereal, such as rice, maize, wheat, barley, millet, rye, triticale, sorghum emmer, spelt, *secale*, einkorn, teff, milo and oats.
21. Harvestable parts of a plant according to item 20, wherein said harvestable parts are preferably shoot biomass and/or seeds.
22. Products derived from a plant according to item 20 and/or from harvestable parts of a plant according to item 21.
23. Use of a nucleic acid encoding an ASPAT polypeptide in increasing yield, particularly in increasing seed yield and/or shoot biomass in plants, relative to control plants.
24. An isolated nucleic acid molecule selected from:
   (a) a nucleic acid represented by any one of SEQ ID NO: 81, 147, 153, 183 and 185;
   (b) the complement of a nucleic acid represented by any one of SEQ ID NO: 81, 147, 153, 183 and 185;
   (c) a nucleic acid encoding the polypeptide as represented by any one of SEQ ID NO: 82, 148, 154, 184 and 186, preferably as a result of the degeneracy of the genetic code, said isolated nucleic acid can be derived from a polypeptide sequence as represented by any one of SEQ ID NO: 82, 148, 154, 184 and 186 and further preferably confers enhanced yield-related traits relative to control plants;
   (d) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A1 and further preferably conferring enhanced yield-related traits relative to control plants;
   (e) a nucleic acid molecule which hybridizes with a nucleic acid molecule of (i) to (iv) under stringent hybridization conditions and preferably confers enhanced yield-related traits relative to control plants;
   (f) a nucleic acid encoding an ASPAT polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 82, 148, 154, 184 and 186 and any of the other amino acid sequences in Table A1 and preferably conferring enhanced yield-related traits relative to control plants.
25. An isolated polypeptide selected from:
   (i) an amino acid sequence represented by any one of SEQ ID NO: 82, 148, 154, 184 and 186;
   (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 82, 148, 154, 184 and 186, and any of the other amino acid sequences in Table A and preferably conferring enhanced yield-related traits relative to control plants.
   (iii) derivatives of any of the amino acid sequences given in (i) or (ii) above.

2. MYB91 like transcription factor (MYB91)

1. A method for increasing yield-related traits in plants relative to control plants, comprising increasing expression in a plant of a nucleic acid sequence encoding a MYB91 like transcription factor (MYB91) polypeptide, which MYB91 polypeptide comprises (i) (i) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 269; and (ii) in increasing order of preference at least 50%, 55%, 60%, 65%, 70%, 75%, 80%, 85%, 90%, 95%, 98%, 99% or more amino acid sequence identity to a MYB DNA binding domain with an InterPro accession number IPR014778, as represented by SEQ ID NO: 270; and (iii) in increasing order of preference at least 50%, 55%, 60%, 65%, 70%, 75%, 80%, 85%, 90%, 95%, 98%, 99% or more amino acid sequence identity to a Conserved Domain as represented by SEQ ID NO: 271, and optionally selecting for plants having increased yield-related traits.

2. Method according to item 1, wherein said MYB91 polypeptide comprises in increasing order of preference at least 50%, 55%, 60%, 65%, 70%, 75%, 80%, 85%, 90%, 95%, 98%, 99% or more amino acid sequence identity to a polypeptide as represented by SEQ ID NO: 221.

3. Method according to item 1, wherein said MYB91 polypeptide comprises in increasing order of preference at least 50%, 55%, 60%, 65%, 70%, 75%, 80%, 85%, 90%, 95%, 98%, 99% or more amino acid sequence identity to any of the polypeptide sequences given in Table A2 herein.

4. Method according to item 1, wherein said MYB91 polypeptide, when used in the construction of a phylogenetic tree of MYB DNA-binding domain polypeptides, such as the one depicted in FIG. 4, clusters with the MYB91 group of polypeptides rather than with any other group.

5. Method according to any preceding item, wherein said nucleic acid sequence encoding a MYB91 polypeptide is represented by any one of the nucleic acid sequence SEQ ID NOs given in Table A2 or a portion thereof, or a sequence capable of hybridising with any one of the nucleic acid sequences SEQ ID NOs given in Table A2, or to a complement thereof.

6. Method according to any preceding item, wherein said nucleic acid sequence encodes an orthologue or paralogue of any of the polypeptide sequence SEQ ID NOs given in Table A2.

7. Method according to any preceding item, wherein said increased expression is effected by any one or more of: T-DNA activation tagging, TILLING, or homologous recombination.

8. Method according to any preceding item, wherein said increased expression is effected by introducing and expressing in a plant a nucleic acid sequence encoding a MYB91 polypeptide.

9. Method according to any preceding item, wherein said increased yield-related trait is one or more of: increased plant height, increased harvest index (HI), and/or increased Thousand Kernel Weight (TKW).

10. Method according to any preceding item, wherein said nucleic acid sequence is operably linked to a constitutive promoter.

11. Method according to item 10, wherein said constitutive promoter is a GOS2 promoter, preferably a GOS2 promoter from rice, most preferably a GOS2 sequence as represented by SEQ ID NO: 272.

12. Method according to any preceding item, wherein said nucleic acid sequence encoding a MYB91 polypeptide is from a plant, further preferably from a dicotyledonous plant, more preferably from the family Salicaceae, most preferably the nucleic acid sequence is from *Populus trichocarpa.*

13. Plants, parts thereof (including seeds), or plant cells obtainable by a method according to any preceding item, wherein said plant, part or cell thereof comprises an isolated nucleic acid transgene encoding a MYB91 polypeptide.

14. Construct comprising:

(a) a nucleic acid sequence encoding a MYB91 polypeptide as defined in any one of items 1 to 6;

(b) one or more control sequences capable of driving expression of the nucleic acid sequence of (a); and optionally (c) a transcription termination sequence.

15. Construct according to item 14 wherein said control sequence is a constitutive promoter.

16. Construct according to item 15 wherein said constitutive promoter is a GOS2 promoter, preferably a GOS2 promoter from rice, most preferably a GOS2 sequence as represented by SEQ ID NO: 272.

17. Use of a construct according to any one of items 14 to 16 in a method for making plants having increased yield-related traits relative to control plants, which increased yield-related traits are one or more of: increased plant height, increased harvest index (HI), and increased Thousand Kernel Weight (TKW).

18. Plant, plant part or plant cell transformed with a construct according to any one of items 14 to 16.

19. Method for the production of transgenic plants having increased yield-related traits relative to control plants, comprising:

(i) introducing and expressing in a plant, plant part, or plant cell, a nucleic acid sequence encoding a MYB91 polypeptide as defined in any one of items 1 to 6; and (ii) cultivating the plant cell, plant part, or plant under conditions promoting plant growth and development.

20. Transgenic plant having increased yield-related traits relative to control plants, resulting from increased expression of an isolated nucleic acid sequence encoding a MYB91 polypeptide as defined in any one of items 1 to 6, or a transgenic plant cell or transgenic plant part derived from said transgenic plant.

21. Transgenic plant according to item 13, 18, or 20, wherein said plant is a crop plant or a monocot or a cereal, such as rice, maize, wheat, barley, millet, rye, triticale, sorghum and oats, or a transgenic plant cell derived from said transgenic plant.

22. Harvestable parts comprising an isolated nucleic acid sequence encoding a MYB91 polypeptide, of a plant according to item 21, wherein said harvestable parts are preferably seeds.

23. Products derived from a plant according to item 21 and/or from harvestable parts of a plant according to item 22.

24. Use of a nucleic acid sequence encoding a MYB91 polypeptide as defined in any one of items 1 to 6, in increasing yield-related traits, comprising one or more of: increased plant height, increased harvest index (HI), and increased Thousand Kernel Weight (TKW).

3. Gibberellic Acid-Stimulated *Arabidopsis* (GASA)

1. A method for enhancing yield-related traits in plants relative to control plants, comprising modulating expression in a plant of a nucleic acid encoding a GASA polypeptide, wherein the sequence of said GASA polypeptide comprises a Pfam PF02704 domain, provided that said GASA protein is not GASA4 as represented by SEQ ID NO: 295.

2. Method according to item 1, wherein said GASA polypeptide comprises one or more of the following motifs:

```
(b) Motif 4,        (SEQ ID NO: 277)

(c) Motif 5,        (SEQ ID NO: 278)

(d) Motif 6         (SEQ ID NO: 279)
```

3. Method according to item 1 or 2, wherein said modulated expression is effected by introducing and expressing in a plant a nucleic acid encoding a GASA polypeptide.
4. Method according to any one of items 1 to 3, wherein said nucleic acid encoding a GASA polypeptide encodes any one of the proteins listed in Table A3 or is a portion of such a nucleic acid, or a nucleic acid capable of hybridising with such a nucleic acid.
5. Method according to any one of items 1 to 4, wherein said nucleic acid sequence encodes an orthologue or paralogue of any of the proteins given in Table A3.
6. Method according to any preceding item, wherein said enhanced yield-related traits comprise increased seed yield relative to control plants.
7. Method according to any one of items 1 to 6, wherein said enhanced yield-related traits are obtained under non-stress conditions.
8. Method according to any one of items 1 to 6, wherein said enhanced yield-related traits are obtained under conditions of drought stress, salt stress or nitrogen deficiency.
9. Method according to any one of items 3 to 8, wherein said nucleic acid is operably linked to a constitutive promoter, preferably to a GOS2 promoter, most preferably to a GOS2 promoter from rice.
10. Method according to any one of items 1 to 9, wherein said nucleic acid encoding a GASA polypeptide is of plant origin, preferably from a dicotyledonous plant.
11. Plant or part thereof, including seeds, obtainable by a method according to any one of items 1 to 10, wherein said plant or part thereof comprises a recombinant nucleic acid encoding a GASA polypeptide.
12. Construct comprising:
    (i) nucleic acid encoding a GASA polypeptide as defined in items 1 or 2;
    (ii) one or more control sequences capable of driving expression of the nucleic acid sequence of (a); and optionally
    (iii) a transcription termination sequence.
13. Construct according to item 12, wherein one of said control sequences is a constitutive promoter, preferably a GOS2 promoter, most preferably a GOS2 promoter from rice.
14. Use of a construct according to item 12 or 13 in a method for making plants having increased yield, particularly increased seed yield relative to control plants.
15. Plant, plant part or plant cell transformed with a construct according to item 12 or 13.
16. Method for the production of a transgenic plant having increased yield, particularly increased seed yield relative to control plants, comprising:
    (i) introducing and expressing in a plant a nucleic acid encoding a GASA polypeptide as defined in item 1 or 2; and
    (ii) cultivating the plant cell under conditions promoting plant growth and development.
17. Transgenic plant having increased yield, particularly increased seed yield, relative to control plants, resulting from modulated expression of a nucleic acid encoding GASA polypeptide as defined in item 1 or 2, or a transgenic plant cell derived from said transgenic plant.
18. Transgenic plant according to item 11, 15 or 17, or a transgenic plant cell derived thereof, wherein said plant is a crop plant or a monocot or a cereal, such as rice, maize, wheat, barley, millet, rye, triticale, sorghum emmer, spelt, *secale*, einkorn, teff, milo and oats.
19. Harvestable parts of a plant according to item 18, wherein said harvestable parts are seeds.
20. Products derived from a plant according to item 18 and/or from harvestable parts of a plant according to item 19.
21. Use of a nucleic acid encoding a GASA polypeptide in increasing yield, particularly in increasing seed yield in plants, relative to control plants.

4. Auxin/Indoleacetic Acid Genes (AUX/IAA)

1. A method for enhancing yield-related traits in plants relative to control plants, comprising modulating expression in a plant of a nucleic acid encoding an AUX/IAA polypeptide comprising an AUX/IAA domain.
2. Method according to item 1, wherein said AUX/IAA domain has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid of an AUX/IAA domain, preferably to the AUX/IAA domain of any of the polypeptides of Table A4, most preferably to the AUX/IAA domain of SEQ ID NO: 432 as represented by the amino acids located between amino acid coordinates 5 to 171.
3. Method according to item 1 wherein said AUX/IAA polypeptide is an IAA14-like polypeptide comprises one or more of the following motifs:
    (i) Motif 13: SEQ ID NO: 739,
    (ii) Motif 14: SEQ ID NO: 740,
    (iii) Motif 15: SEQ ID NO: 741,
    (iv) Motif 16: SEQ ID NO: 742,
    (v) Motif 17: SEQ ID NO: 743,
    (vi) Motif 18: SEQ ID NO: 744.
4. Method according to item 1 to 3, wherein said modulated expression is effected by introducing and expressing in a plant a nucleic acid encoding an AUX/IAA polypeptide.
5. Method according to any one of items 1 to 4, wherein said nucleic acid encoding an AUX/IAA polypeptide encodes any one of the proteins listed in Table A4 or in Table A5 or is a portion of such a nucleic acid, or a nucleic acid capable of hybridising with such a nucleic acid.
6. Method according to any one of items 1 to 5, wherein said nucleic acid sequence encodes an orthologue or paralogue of any of the proteins given in Table A4 or in Table A5.
7. Method according to any preceding item, wherein said enhanced yield-related traits comprise increased yield, preferably increased biomass and/or increased seed yield relative to control plants.
8. Method according to any one of items 1 to 7, wherein said enhanced yield-related traits are obtained under non-stress conditions.
9. Method according to any one of items 3 to 8, wherein said nucleic acid is operably linked to a constitutive promoter, preferably to a GOS2 promoter, most preferably to a GOS2 promoter from rice.
10. Method according to any one of items 1 to 9, wherein said nucleic acid encoding an AUX/IAA polypeptide is of plant origin, preferably from a monocotyledonous plant, further preferably from the family Poaceae, more preferably from the genus *Oryza*, most preferably from *Oryza sativa*.

11. Plant or part thereof, including seeds, obtainable by a method according to any one of items 1 to 10, wherein said plant or part thereof comprises a recombinant nucleic acid encoding an AUX/IAA polypeptide.

12. Construct comprising:
  (i) nucleic acid encoding an AUX/IAA polypeptide as defined in items 1 or 2;
  (ii) one or more control sequences capable of driving expression of the nucleic acid sequence of (a); and optionally
  (iii) a transcription termination sequence.

13. Construct according to item 12, wherein one of said control sequences is a constitutive promoter, preferably a GOS2 promoter, most preferably a GOS2 promoter from rice.

14. Use of a construct according to item 12 or 13 in a method for making plants having increased yield, particularly increased biomass and/or increased seed yield relative to control plants.

15. Plant, plant part or plant cell transformed with a construct according to item 12 or 13.

16. Method for the production of a transgenic plant having increased yield, particularly increased biomass and/or increased seed yield relative to control plants, comprising:
  (i) introducing and expressing in a plant a nucleic acid encoding an AUX/IAA polypeptide as defined in item 1 or 2; and
  (ii) cultivating the plant cell under conditions promoting plant growth and development.

17. Transgenic plant having increased yield, particularly increased biomass and/or increased seed yield, relative to control plants, resulting from modulated expression of a nucleic acid encoding an AUX/IAA polypeptide as defined in item 1 or 2, or a transgenic plant cell derived from said transgenic plant.

18. Transgenic plant according to item 11, 15 or 17, or a transgenic plant cell derived thereof, wherein said plant is a crop plant or a monocot or a cereal, such as rice, maize, wheat, barley, millet, rye, triticale, sorghum emmer, spelt, *secale*, einkorn, teff, milo and oats.

19. Harvestable parts of a plant according to item 18, wherein said harvestable parts are preferably shoot biomass and/or seeds.

20. Products derived from a plant according to item 18 and/or from harvestable parts of a plant according to item 19.

21. Use of a nucleic acid encoding an AUX/IAA polypeptide in increasing yield, particularly in increasing seed yield and/or shoot biomass in plants, relative to control plants.

DESCRIPTION OF FIGURES

The present invention will now be described with reference to the following figures in which:

FIG. 1 represents a multiple alignment of ASPAT polypeptides. Sequences shown are 100 (SEQ ID NO: 100); 102 (SEQ ID NO: 102); 110 (SEQ ID NO: 110); 76 (SEQ ID NO: 76); 112 (SEQ ID NO: 112); 114 (SEQ ID NO: 114); 118 (SEQ ID NO: 118); 170 (SEQ ID NO: 170); 172 (SEQ ID NO: 172); 174 (SEQ ID NO: 174); 176 (SEQ ID NO: 176); 44 (SEQ ID NO: 44); 2 (SEQ ID NO: 4); 4 (SEQ ID NO: 2); 24 (SEQ ID NO: 24); 6 (SEQ ID NO: 6); 14 (SEQ ID NO: 14); 8 (SEQ ID NO: 8); 50 (SEQ ID NO: 50); 54-(SEQ ID NO: 54); and 62 (SEQ ID NO: 62).

FIG. 5 shows a ClustalW 1.81 multiple sequence alignment of the MYB91 polypeptides from Table A2. Two MYB DNA binding domains with an InterPro accession number IPR014778, a MYB transcription factor with an InterPro accession number IPR015495, and a C-terminal Conserved Domain, are marked with X's below the consensus sequence. Sequences shown are Poptr_MYB91 (SEQ ID NO: 221); Medtr_MYB91_PHAN_ (SEQ ID NO: 251); Pissa_MYB91 (SEQ ID NO: 259); Glyma_MYB91_PHANa_ (SEQ ID NO: 237); Glyma_MYB91_PHANb_ (SEQ ID NO: 239); Lotco_MYB91_PHANb_ (SEQ ID NO: 245); Lotco_MYB91_PHANa_ (SEQ ID NO: 243); Eucgr_MYB91 (SEQ ID NO: 235); Maldo_MYB91 (SEQ ID NO: 249); Lyces_MYB91 (SEQ ID NO: 247); Soltu_MYB91 (SEQ ID NO: 261); Nicta_MYB91 (SEQ ID NO: 255); Vitvi_MYB91 (SEQ ID NO: 263); Goshi_MYB91 (SEQ ID NO: 241); Aqufo_MYB91 (SEQ ID NO: 225); Esc-ca_MYB91 (SEQ ID NO: 233); Arath_AS1_MYB91 (SEQ ID NO: 227); Carhi_MYB91 (SEQ ID NO: 231); Bran-a_MYB91 (SEQ ID NO: 229); Antma_MYB91 (SEQ ID NO: 223); Orysa_MYB91 (SEQ ID NO: 257); Zeama_MYB91_RS2_ (SEQ ID NO: 265); and Moral_MYB91 (SEQ ID NO: 253).

FIG. 7 represents the domain structure of SEQ ID NO: 276 with the GASA domain PF02704 indicated in bold. The putative secretion signal peptide (amino acid 1-24) is underlined.

FIG. 8 represents a multiple alignment of various GASA proteins. The motifs 4 to 12 or other motifs can be deduced herefrom. Sequences shown are Os05g0432200 (SEQ ID NO: 304); AK110640 (SEQ ID NO: 308); TA53297_4565 (SEQ ID NO: 345); TA52915_4565 (SEQ ID NO: 355);

scaff_41.75 (SEQ ID NO: 323); TA52374_4081 (SEQ ID NO: 333); TA5035_4679 (SEQ ID NO: 297); Os09g0414900 (SEQ ID NO: 305); GASA6 (SEQ ID NO: 296); scaff_XVII.377 (SEQ ID NO: 316); TA56938_4081 (SEQ ID NO: 336); GASA4 (SEQ ID NO: 295); Os05g0376800 (SEQ ID NO: 300); scaff_VI.397 (SEQ ID NO: 315); scaff_I.1483 (SEQ ID NO: 319); BG128975 (SEQ ID NO: 332); BG130916 (SEQ ID NO: 337); TA52635_4081 SEQ ID2_ (SEQ ID NO: 338); TA5923_4679 (SEQ ID NO: 298); Os06g0266800 (SEQ ID NO: 309); TA100367_4565 (SEQ ID NO: 348); CA725087 (SEQ ID NO: 343); TA77646_4565 (SEQ ID NO: 359); TA92393_4565 (SEQ ID NO: 349); CK153563 (SEQ ID NO: 353); BI208422 (SEQ ID NO: 331); TA37180_4081 (SEQ ID NO: 334); scaff_II.2328 (SEQ ID NO: 325); scaff_II.2330 (SEQ ID NO: 313); GASA5 (SEQ ID NO: 294); GASA12 (SEQ ID NO: 293); Os10g0115550 (SEQ ID NO: 302); TA101332_4565 (SEQ ID NO: 346); TA56201_4081 (SEQ ID NO: 341); AJ785329 (SEQ ID NO: 342); AK105729 (SEQ ID NO: 303); Os03g0760800 (SEQ ID NO: 310); TA66036_4565 (SEQ ID NO: 347); BM136027 (SEQ ID NO: 350); CA705831 (SEQ ID NO: 351); CA593033 (SEQ ID NO: 352); TA66038_4565 (SEQ ID NO: 354); CD899399 (SEQ ID NO: 358); Os03g0607200 (SEQ ID NO: 306); scaff_IX.735 (SEQ ID NO: 314); scaff_I.2410 (SEQ ID NO: 318); Pop_GASA_ (SEQ ID NO: 291); scaff_40.379 (SEQ ID NO: 322); TA45751_4081 (SEQ ID NO: 328); scaff_205.30 (SEQ ID NO: 311); TA69823_4565 (SEQ ID NO: 344); TA69821_4565 (SEQ ID NO: 356); Os07g0592000 (SEQ ID NO: 307); Os04g0465300 (SEQ ID NO: 301); scaff_II.204 (SEQ ID NO: 312); scaff_II.202 (SEQ ID NO: 317); TA35962_4081 (SEQ ID NO: 330); scaff_II.203 (SEQ ID NO: 326); BE353147 (SEQ ID NO: 335); TA41886_4081 (SEQ ID NO: 339); scaff_XII.704 (SEQ ID NO: 321); scaff_XV.507 (SEQ ID NO: 324); TA48119_4081 (SEQ ID NO: 329); Mt_GASA (SEQ ID NO: 292); scaff_I.1926 (SEQ ID NO: 320); scaff_XIX.758 (SEQ ID NO: 327); TA36295_4081 (SEQ ID NO: 340); TA95153_4565 (SEQ ID NO: 357); and TA51752_4565 (SEQ ID NO: 360).

Figure 9:
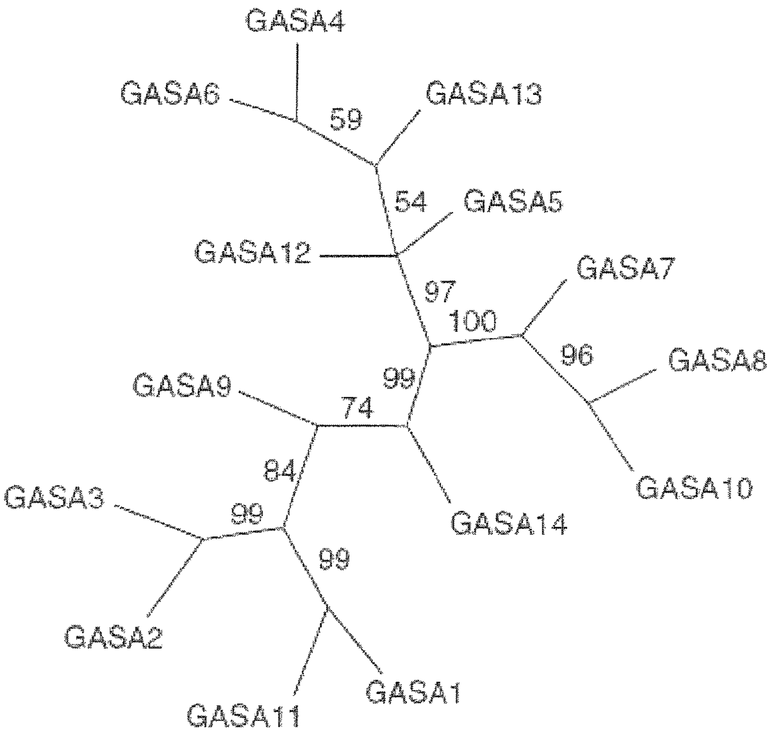

FIG. 9 shows a phylogenetic tree of *Arabidopsis* GASA proteins (Roxrud et al. 2007). Starting from a multiple alignment with ClustalW (Thompson et al., Nucleic Acids Res. 22, 4673-4680, 1994), a neighbour-joining phylogenetic tree was obtained using the PAUP v.4.0 software (paup.csit.fsu.edu), and statistical confidence was calculated by bootstrap analysis with 1,000 resamplings.

Figure 10:
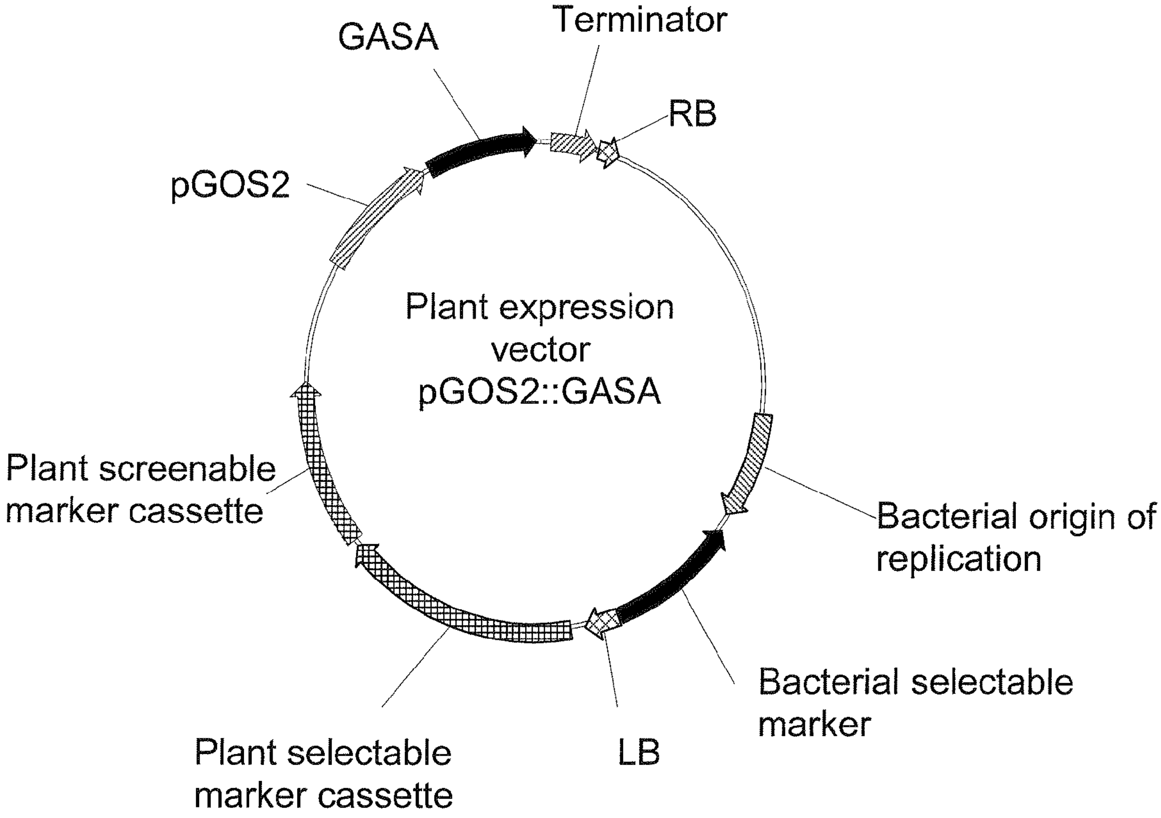

FIG. 10 represents the binary vector for increased expression in *Oryza sativa* of a GASA-encoding nucleic acid under the control of a rice GOS2 promoter (pGOS2).

FIG. 11 represents a multiple alignment of AUX/IAA polypeptides.

FIG. 12 represents the binary vector used for increased expression in *Oryza sativa* of an AUX/IAA encoding nucleic acid under the control of a rice GOS2 promoter (pGOS2).

FIG. 13 represents the domain structure of SEQ ID NO: 738 with the AUX/IAA domain in bold and the conserved motifs underlined.

FIG. 14 represents a multiple alignment of IAA14-like protein sequences. Sequences shown are AT3G23050.1 (SEQ ID NO: 748); AT3G23050.2 (SEQ ID NO: 749); AT4G14550.1 (SEQ ID NO: 738); Mt_TA20354 (SEQ ID NO: 752); Pt_566151 (SEQ ID NO: 750); Pt_720961 (SEQ ID NO: 751); Sl_TA40922 (SEQ ID NO: 753); AT1G04250.1 (SEQ ID NO: 754); Mt_TA27011 (SEQ ID NO: 760); Mt_TA22814 (SEQ ID NO: 761); Pt_643213 (SEQ ID NO: 762); Sl_TA48108 (SEQ ID NO: 759); Os_CB657009 (SEQ ID NO: 755); Os_TA41733 (SEQ ID NO: 756); AT3G04730.1 (SEQ ID NO: 758); Mt_TA20951 (SEQ ID NO: 757); Mt_TA25400 (SEQ ID NO: 779); Pt_584053 (SEQ ID NO: 781); Pt_711734 (SEQ ID NO: 780); AT4G29080.1 (SEQ ID NO: 778); Mt_TA23062 (SEQ ID NO: 782); AT3G23030.1 (SEQ ID NO: 763); AT4G14560.1 (SEQ ID NO: 764); Sl_TA38817 (SEQ ID NO: 766); Sl_TA43058 (SEQ ID NO: 767); Pt_726443 (SEQ ID NO: 768); Pt_564913 (SEQ ID NO: 769); Mt_TA20557 (SEQ ID NO: 772); Pt_831610 (SEQ ID NO: 770); Pt_798526 (SEQ ID NO: 771); Mt_TA31746 (SEQ ID NO: 776); Pt_823671 (SEQ ID NO: 774); Pt_595419 (SEQ ID NO: 775); Mt_TA20558 (SEQ ID NO: 773); AT1G04240.1 (SEQ ID NO: 765); and Sl_TA42190 (SEQ ID NO: 777).

Figure 15:
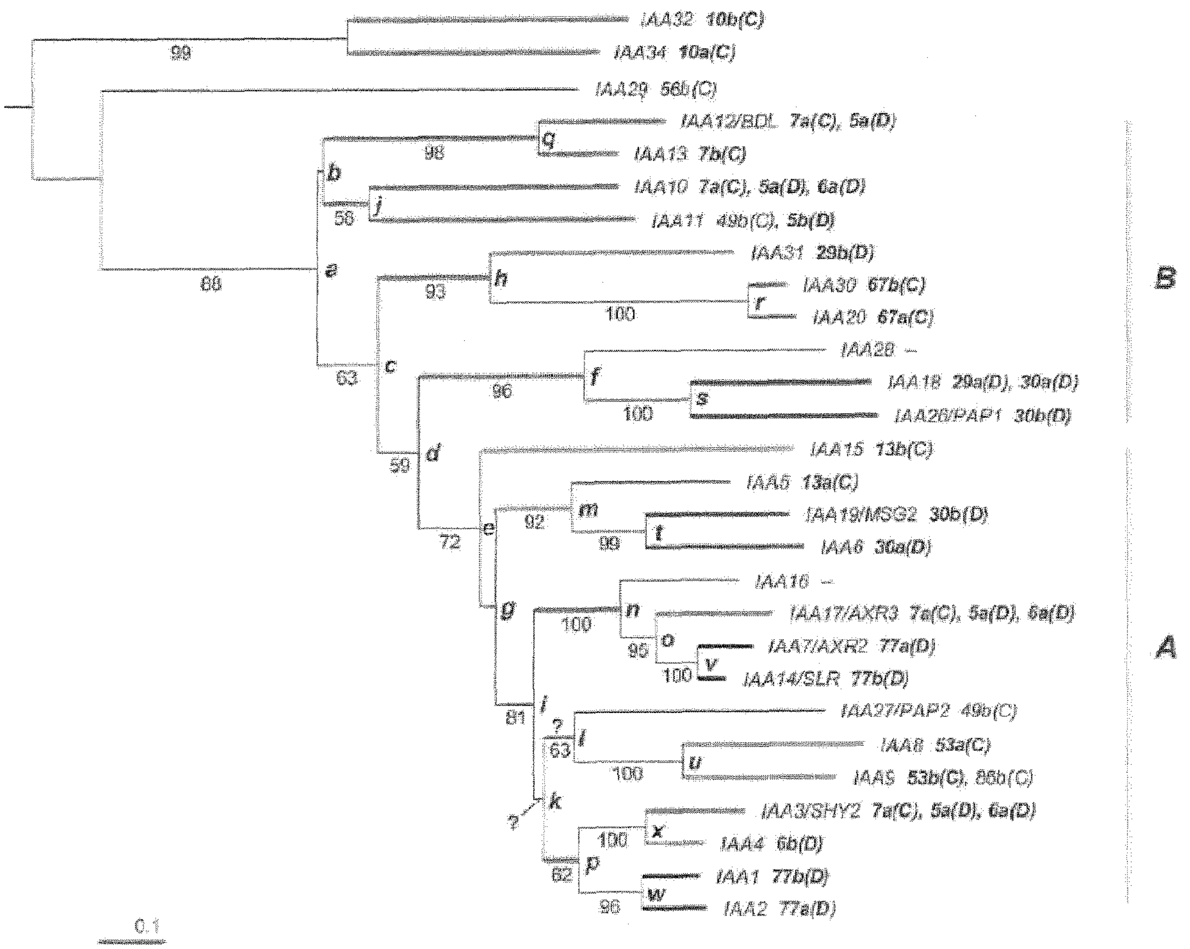

FIG. 15 shows a neighbour-joining tree of *Arabidopsis* IAA proteins (Remington et al., 2004). SEQ ID NO: 738 is represented by IAA14 in Group A and IAA14-like proteins preferably cluster in this Group A.

Figure 16:
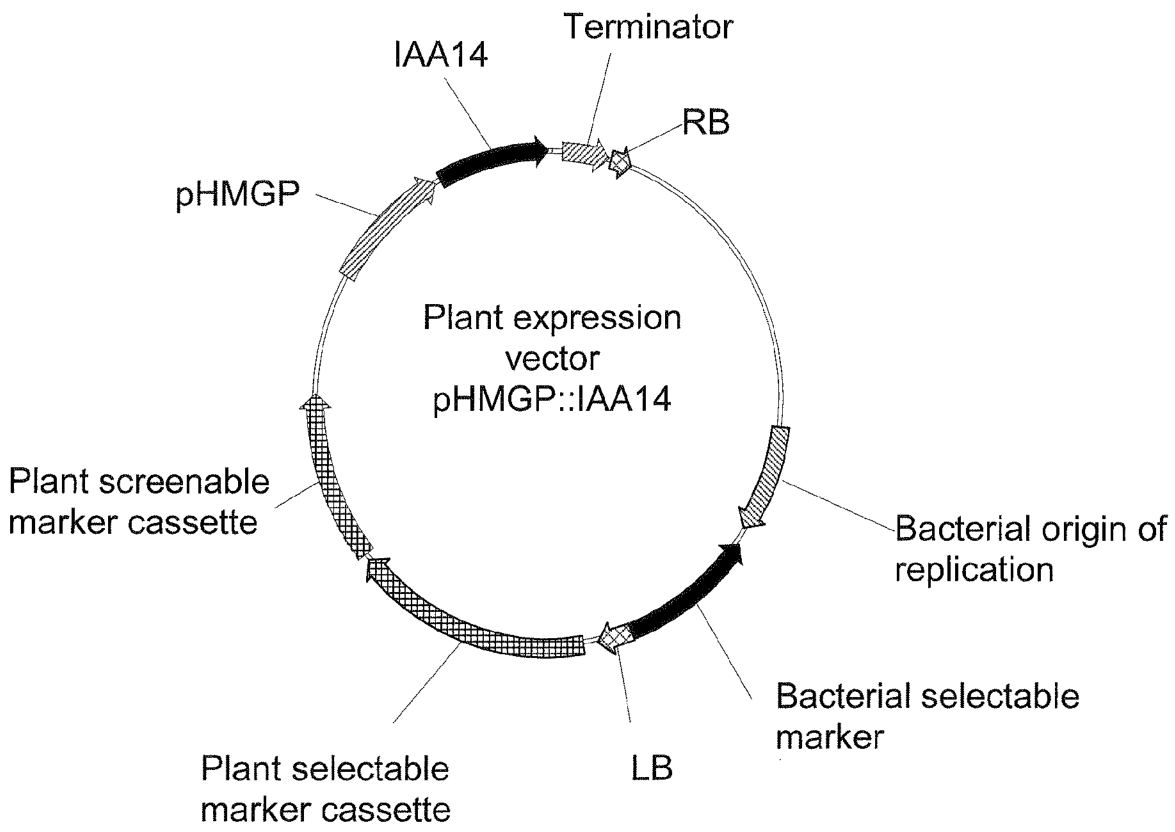

FIG. 16 represents the binary vector used for increased expression in *Oryza sativa* of an IAA14-like-encoding nucleic acid under the control of a rice HMGP promoter (pHMGP).

EXAMPLES

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of the Invention Sequences (full length cDNA, ESTs or genomic) related to the nucleic acid sequence used in the methods of the present invention were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid used in the present invention was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids)

between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

1.1. Aspartate AminoTransferase (ASPAT)

Table A1 provides a list of nucleic acid sequences related to the nucleic acid sequence used in the methods of the present invention.

TABLE A1

Examples of ASPAT polypeptides:

| Reference number | Name | Nucleic acid SEQ ID NO: | Amino acid SEQ ID NO: |
|---|---|---|---|
| 1 | O. sativa_Os01g0760600 | 1 | 2 |
| 1 | O. sativa_Os01g0760600-truncated | 3 | 4 |
| 1 | A. thaliana_AT5G19550 | 5 | 6 |
| 1 | A. thaliana_AT5G11520 | 7 | 8 |
| 1 | A. thaliana_AT4G31990 | 9 | 10 |
| 6 | A. thaliana_AT1G62800 | 11 | 12 |
| 7 | B. napus_TA23207 | 13 | 14 |
| 8 | B. napus_TA23768 | 15 | 16 |
| 9 | C. sinensis_TA12564 | 17 | 18 |
| 10 | C. solstitialis_TA659 | 19 | 20 |
| 11 | G. hirsutum_TA23799 | 21 | 22 |
| 12 | G. max_AF034210 | 23 | 24 |
| 13 | G. raimondii_TA9413 | 25 | 26 |
| 14 | H. annuus_TA8926 | 27 | 28 |
| 15 | H. paradoxus_TA2606 | 29 | 30 |
| 16 | J. regia_TA762 | 31 | 32 |
| 17 | L. japonicus_TA1537 | 33 | 34 |
| 18 | L. perennis_TA512 | 35 | 36 |
| 19 | L. perennis_TA605 | 37 | 38 |
| 20 | N. tabacum_TA13125 | 39 | 40 |
| 21 | P. glauca_TA15326 | 41 | 42 |
| 22 | P. patens_136815 | 43 | 44 |
| 23 | P. persica_TA3273 | 45 | 46 |
| 24 | P. sitchensis_TA22265 | 47 | 48 |
| 25 | P. trichocarpa_819551 | 49 | 50 |
| 26 | P. trifoliata_TA8305 | 51 | 52 |
| 27 | S. lycopersicum_TA38054 | 53 | 54 |
| 28 | S. officinarum_TA26595 | 55 | 56 |
| 29 | T. aestivum_TA52678 | 57 | 58 |
| 30 | V. carteri_82929 | 59 | 60 |
| 31 | V. vinifera_GSVIVT00016723001 | 61 | 62 |
| 32 | V. vinifera_GSVIVT00032463001 | 63 | 64 |
| 33 | Z. mays_TA9042 | 65 | 66 |
| 34 | C. reinhardtii_186959 | 67 | 68 |
| 35 | C. solstitialis_TA2275 | 69 | 70 |
| 36 | C. tinctorius_TA12 | 71 | 72 |
| 37 | G. hirsutum_TA24406 | 73 | 74 |
| 38 | G. max_TA61768 | 75 | 76 |
| 39 | G. raimondii_TA9928 | 77 | 78 |
| 40 | H. exilis_TA1663 | 79 | 80 |
| 41 | H. vulgare_BPS_7992 | 81 | 82 |
| 42 | L. japonicus_TA1466 | 83 | 84 |
| 43 | M. polymorpha_TA825 | 85 | 86 |
| 44 | N. tabacum_TA13015 | 87 | 88 |
| 45 | O. sativa_Os02g0797500 | 89 | 90 |
| 46 | P. glauca_TA14780 | 91 | 92 |
| 47 | P. patens_102134 | 93 | 94 |
| 48 | P. sitchensis_TA20968 | 95 | 96 |
| 49 | P. taeda_TA6616 | 97 | 98 |
| 50 | P. trichocarpa_654206 | 99 | 100 |
| 51 | P. trichocarpa_835828 | 101 | 102 |
| 52 | P. vulgaris_TA4043 | 103 | 104 |
| 53 | S. tuberosum_TA23192 | 105 | 106 |
| 54 | V. carteri_81153 | 107 | 108 |
| 55 | V. vinifera_GSVIVT00032723001 | 109 | 110 |
| 56 | Z. mays_TA10886 | 111 | 112 |
| 57 | A. thaliana_AT2G30970 | 113 | 114 |
| 58 | C. sinensis_TA15250 | 115 | 116 |
| 59 | G. max_TA50178 | 117 | 118 |
| 60 | G. raimondii_TA9985 | 119 | 120 |
| 61 | H. vulgare_TA32835 | 121 | 122 |
| 62 | H. vulgare_TA36301 | 123 | 124 |
| 63 | O. lucimarinus_31597 | 125 | 126 |
| 64 | O. sativa_Os02g0236000 | 127 | 128 |
| 65 | O. sativa_Os06g0548000 | 129 | 130 |
| 66 | O. taurii_32764 | 131 | 132 |
| 67 | P. patens_169868 | 133 | 134 |
| 68 | P. sitchensis_TA23007 | 135 | 136 |
| 69 | P. taeda_TA7145 | 137 | 138 |
| 70 | V. vinifera_GSVIVT00018772001 | 139 | 140 |
| 71 | V. vinifera_GSVIVT00037462001 | 141 | 142 |
| 72 | A. anophagefferens_21970 | 143 | 144 |
| 73 | A. thaliana_AT2G22250.2 | 145 | 146 |
| 74 | B. napus_BPS_9867 | 147 | 148 |
| 75 | C. reinhardtii_118364 | 149 | 150 |
| 76 | G. hirsutum_TA27281 | 151 | 152 |
| 77 | G. max_BPS_36342 | 153 | 154 |
| 78 | H. vulgare_TA28738 | 155 | 156 |
| 79 | M. domestica_TA26867 | 157 | 158 |
| 80 | N. tabacum_TA15308 | 159 | 160 |
| 81 | O. basilicum_TA1043 | 161 | 162 |
| 82 | O. sativa_Os01g0871300 | 163 | 164 |
| 83 | P. patens_127152 | 165 | 166 |
| 84 | P. pinaster_TA3616_71647 | 167 | 168 |
| 85 | P. trichocarpa_scaff_V.183 | 169 | 170 |
| 86 | P. trichocarpa_scaff_VII.574 | 171 | 172 |
| 87 | S. lycopersicum_TA37592 | 173 | 174 |
| 88 | S. tuberosum_TA27739 | 175 | 176 |
| 89 | T. aestivum_TA71539 | 177 | 178 |
| 90 | V. carteri_103084 | 179 | 180 |
| 91 | V. vinifera_GSVIVT00019453001 | 181 | 182 |
| 92 | Z. mays_BPS_26636 | 183 | 184 |
| 93 | Z. mays_BPS_4233 | 185 | 186 |

In some instances, related sequences is tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been from particular organisms, such as those maintained by the Joint Genome Institute, like the poplar genome sequences have been screened.

Further, access to proprietary databases, has allowed the identification of other nucleic acid and polypeptide sequences using the Blast algorithm as described above.

1.2. MYB91 like transcription factor (MYB91)

Table A2 provides a list of nucleic acid sequences related to the nucleic acid sequence used in the methods of the present invention.

TABLE A2

Examples of MYB91 polypeptide sequences, and encoding nucleic acid sequences

| Name | Public database accession number | Nucleic acid SEQ ID NO: | Poly-peptide SEQ ID NO: |
|---|---|---|---|
| Poptr_MYB91 | NA | 220 | 221 |
| Antma_MYB91 (PHAN) | AJ005586 | 222 | 223 |

TABLE A2-continued

| Examples of MYB91 polypeptide sequences, and encoding nucleic acid sequences | | | |
|---|---|---|---|
| Name | Public database accession number | Nucleic acid SEQ ID NO: | Poly-peptide SEQ ID NO: |
| Aqufo_MYB91 | DR919410 DR919310 | 224 | 225 |
| Arath_MYB91 (AS1) | AT2G37630 | 226 | 227 |
| Brana_MYB91 | BN06MC30974_51405116 @30844#1 | 228 | 229 |
| Carhi_MYB91 | DQ512733 | 230 | 231 |
| Escca_MYB91 | AY228766 | 232 | 233 |
| Eucgr_MYB91 | BD376532 | 234 | 235 |
| Glyma_MYB91 (PHANa) | AY790252 | 236 | 237 |
| Glyma_MYB91 (PHANb) | AY790253 | 238 | 239 |
| Goshi_MYB91 | DT554770 DW499296 | 240 | 241 |
| Lotco_MYB91 (PHANa) | AY790244 | 242 | 243 |
| Lotco_MYB91 (PHANb) | AY790245 | 244 | 245 |
| Lyces_MYB91 | AF148934 | 246 | 247 |
| Maldo_MYB91 | DQ074473 | 248 | 249 |
| Medtr_MYB91 PHAN | DQ468322 | 250 | 251 |
| Moral_MYB91 PHAN1 | EF408927 | 252 | 253 |
| Nicta_MYB91 | AY559043 | 254 | 255 |
| Orysa_MYB91 | Os12g0572000 NM_001073621 | 256 | 257 |
| Pissa_MYB91 (PHAN1) | AF299140.2 | 258 | 259 |
| Soltu_MYB91 | CK274535 | 260 | 261 |
| Vitvi_MYB91 | AM474349 | 262 | 263 |
| Zeama_MYB91 (RS2) | AF126489 | 264 | 265 |
| Horvu_MYB91 partial | BF617675.2 BG343686.1 | 266 | 267 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to proprietary databases, has allowed the identification of novel nucleic acid and polypeptide sequences.

1.3. Gibberellic Acid-Stimulated *Arabidopsis* (GASA)

Table A3 provides a list of nucleic acid sequences related to the nucleic acid sequence used in the methods of the present invention.

TABLE A3

| Examples of GASA polypeptides: | | |
|---|---|---|
| Name | Polypeptide SEQ ID NO | Nucleic acid SEQ ID NO |
| Le_GASA growth induced | 276 | 275 |
| Pop_GASA growth regulated | 291 | 361 |
| Mt_GASA growth regulated | 292 | 362 |
| GASA12 At2g30810 | 293 | 363 |
| GASA5 At3g02885 | 294 | 364 |
| GASA4 At5g15230 | 295 | 365 |

TABLE A3-continued

| Examples of GASA polypeptides: | | |
|---|---|---|
| Name | Polypeptide SEQ ID NO | Nucleic acid SEQ ID NO |
| GASA6 At1g74670 | 296 | 366 |
| TA5035_4679#1 | 297 | 367 |
| TA5923_4679#1 | 298 | 368 |
| TA3842_4679#1 | 299 | 369 |
| Os05g0376800#1 | 300 | 370 |
| Os04g0465300#1 | 301 | 371 |
| Os10g0115550#1 | 302 | 372 |
| AK105729#1 | 303 | 373 |
| Os05g0432200#1 | 304 | 374 |
| Os09g0414900#1 | 305 | 375 |
| Os03g0607200#1 | 306 | 376 |
| Os07g0592000#1 | 307 | 377 |
| AK110640#1 | 308 | 378 |
| Os06g0266800#1 | 309 | 379 |
| Os03g0760800#1 | 310 | 380 |
| scaff_205.30#1 | 311 | 381 |
| scaff_II.204#1 | 312 | 382 |
| scaff_II.2330#1 | 313 | 383 |
| scaff_IX.735#1 | 314 | 384 |
| scaff_VI.397#1 | 315 | 385 |
| scaff_XVII.377#1 | 316 | 386 |
| scaff_II.202#1 | 317 | 387 |
| scaff_I.2410#1 | 318 | 388 |
| scaff_I.1483#1 | 319 | 389 |
| scaff_I.1926#1 | 320 | 390 |
| scaff_XII.704#1 | 321 | 391 |
| scaff_40.379#1 | 322 | 392 |
| scaff_41.75#1 | 323 | 393 |
| scaff_XV.507#1 | 324 | 394 |
| scaff_II.2328#1 | 325 | 395 |
| scaff_II.203#1 | 326 | 396 |
| scaff_XIX.758#1 | 327 | 397 |
| TA45751_4081#1 | 328 | 398 |
| TA48119_4081#1 | 329 | 399 |
| TA35962_4081#1 | 330 | 400 |
| BI208422#1 | 331 | 401 |
| BG128975#1 | 332 | 402 |
| TA52374_4081#1 | 333 | 403 |
| TA37180_4081#1 | 334 | 404 |
| BE353147#1 | 335 | 405 |
| TA56938_4081#1 | 336 | 406 |
| BG130916#1 | 337 | 407 |
| TA52635_4081#1 | 338 | 408 |
| TA41886_4081#1 | 339 | 409 |
| TA36295_4081#1 | 340 | 410 |
| TA56201_4081#1 | 341 | 411 |
| AJ785329#1 | 342 | 412 |
| CA725087#1 | 343 | 413 |
| TA69823_4565#1 | 344 | 414 |
| TA53297_4565#1 | 345 | 415 |
| TA101332_4565#1 | 346 | 416 |
| TA66036_4565#1 | 347 | 417 |
| TA100367_4565#1 | 348 | 418 |
| TA92393_4565#1 | 349 | 419 |
| BM136027#1 | 350 | 420 |
| CA705831#1 | 351 | 421 |
| CA593033#1 | 352 | 422 |
| CK153563#1 | 353 | 423 |
| TA66038_4565#1 | 354 | 424 |
| TA52915_4565#1 | 355 | 425 |
| TA69821_4565#1 | 356 | 426 |
| TA95153_4565#1 | 357 | 427 |
| CD899399#1 | 358 | 428 |
| TA77646_4565#1 | 359 | 429 |
| TA51752_4565#1 | 360 | 430 |

In some instances, related sequences have tentatively been assembled and publicly disclosed by research institutions, such as The Institute for Genomic Research (TIGR). The Eukaryotic Gene Orthologs (EGO) database may be used to identify such related sequences, either by keyword search or by using the BLAST algorithm with the nucleic acid or polypeptide sequence of interest.

1.4. Auxin/Indoleacetic Acid Genes (AUX/IAA)

| Nucleic acid name | Nucleic Acid SEQ ID NO: | Polypeptide name | Polypeptide SEQ ID NO: |
|---|---|---|---|
| seqidno01; DNA; *Oryza sativa* | 431 | seqidno02; PRT; *Oryza sativa* | 432 |
| seqidno1; DNA; *Arabidopsis thaliana* | 433 | seqidno2; PRT; *Arabidopsis thaliana* | 434 |
| seqidno3; DNA; *Arabidopsis thaliana* | 435 | seqidno4; PRT; *Arabidopsis thaliana* | 436 |
| seqidno5; DNA; *Arabidopsis thaliana* | 437 | seqidno6; PRT; *Arabidopsis thaliana* | 438 |
| seqidno7; DNA; *Arabidopsis thaliana* | 439 | seqidno8; PRT; *Arabidopsis thaliana* | 440 |
| seqidno9; DNA; *Arabidopsis thaliana* | 441 | seqidno10; PRT; *Arabidopsis thaliana* | 442 |
| seqidno11; DNA; *Arabidopsis thaliana* | 443 | seqidno12; PRT; *Arabidopsis thaliana* | 444 |
| seqidno13; DNA; *Arabidopsis thaliana* | 445 | seqidno14; PRT; *Arabidopsis thaliana* | 446 |
| seqidno15; DNA; *Arabidopsis thaliana* | 447 | seqidno16; PRT; *Arabidopsis thaliana* | 448 |
| seqidno17; DNA; *Arabidopsis thaliana* | 449 | seqidno18; PRT; *Arabidopsis thaliana* | 450 |
| seqidno19; DNA; *Arabidopsis thaliana* | 451 | seqidno20; PRT; *Arabidopsis thaliana* | 452 |
| seqidno21; DNA; *Arabidopsis thaliana* | 453 | seqidno22; PRT; *Arabidopsis thaliana* | 454 |
| seqidno23; DNA; *Arabidopsis thaliana* | 455 | seqidno24; PRT; *Arabidopsis thaliana* | 456 |
| seqidno25; DNA; *Arabidopsis thaliana* | 457 | seqidno26; PRT; *Arabidopsis thaliana* | 458 |
| seqidno27; DNA; *Arabidopsis thaliana* | 459 | seqidno28; PRT; *Arabidopsis thaliana* | 460 |
| seqidno29; DNA; *Arabidopsis thaliana* | 461 | seqidno30; PRT; *Arabidopsis thaliana* | 462 |
| seqidno31; DNA; *Arabidopsis thaliana* | 463 | seqidno32; PRT; *Arabidopsis thaliana* | 464 |
| seqidno33; DNA; *Arabidopsis thaliana* | 465 | seqidno34; PRT; *Arabidopsis thaliana* | 466 |
| seqidno35; DNA; *Arabidopsis thaliana* | 467 | seqidno36; PRT; *Arabidopsis thaliana* | 468 |
| seqidno37; DNA; *Arabidopsis thaliana* | 469 | seqidno38; PRT; *Arabidopsis thaliana* | 470 |
| seqidno39; DNA; *Arabidopsis thaliana* | 471 | seqidno40; PRT; *Arabidopsis thaliana* | 472 |
| seqidno41; DNA; *Arabidopsis thaliana* | 473 | seqidno42; PRT; *Arabidopsis thaliana* | 474 |
| seqidno43; DNA; *Arabidopsis thaliana* | 475 | seqidno44; PRT; *Arabidopsis thaliana* | 476 |
| seqidno45; DNA; *Arabidopsis thaliana* | 477 | seqidno46; PRT; *Arabidopsis thaliana* | 478 |
| seqidno47; DNA; *Arabidopsis thaliana* | 479 | seqidno48; PRT; *Arabidopsis thaliana* | 480 |
| seqidno49; DNA; *Arabidopsis thaliana* | 481 | seqidno50; PRT; *Arabidopsis thaliana* | 482 |
| seqidno51; DNA; *Arabidopsis thaliana* | 483 | seqidno52; PRT; *Arabidopsis thaliana* | 484 |
| seqidno53; DNA; *Arabidopsis thaliana* | 485 | seqidno54; PRT; *Arabidopsis thaliana* | 486 |
| seqidno55; DNA; *Arabidopsis thaliana* | 487 | seqidno56; PRT; *Arabidopsis thaliana* | 488 |
| seqidno57; DNA; *Arabidopsis thaliana* | 489 | seqidno58; PRT; *Arabidopsis thaliana* | 490 |
| seqidno59; DNA; *Arabidopsis thaliana* | 491 | seqidno60; PRT; *Arabidopsis thaliana* | 492 |
| seqidno61; DNA; *Arabidopsis thaliana* | 493 | seqidno62; PRT; *Arabidopsis thaliana* | 494 |
| seqidno63; DNA; *Arabidopsis thaliana* | 495 | seqidno64; PRT; *Arabidopsis thaliana* | 496 |
| seqidno65; DNA; *Arabidopsis thaliana* | 497 | seqidno66; PRT; *Arabidopsis thaliana* | 498 |
| seqidno67; DNA; *Arabidopsis thaliana* | 499 | seqidno68; PRT; *Arabidopsis thaliana* | 500 |
| seqidno69; DNA; *Oryza sativa* | 501 | seqidno70; PRT; *Oryza sativa* | 502 |
| seqidno71; DNA; *Oryza sativa* | 503 | seqidno72; PRT; *Oryza sativa* | 504 |
| seqidno73; DNA; *Oryza sativa* | 505 | seqidno74; PRT; *Oryza sativa* | 506 |
| seqidno75; DNA; *Oryza sativa* | 507 | seqidno76; PRT; *Oryza sativa* | 508 |
| seqidno77; DNA; *Oryza sativa* | 509 | seqidno78; PRT; *Oryza sativa* | 510 |
| seqidno79; DNA; *Oryza sativa* | 511 | seqidno80; PRT; *Oryza sativa* | 512 |
| seqidno81; DNA; *Oryza sativa* | 513 | seqidno82; PRT; *Oryza sativa* | 514 |
| seqidno83; DNA; *Oryza sativa* | 515 | seqidno84; PRT; *Oryza sativa* | 516 |
| seqidno85; DNA; *Oryza sativa* | 517 | seqidno86; PRT; *Oryza sativa* | 518 |
| seqidno87; DNA; *Oryza sativa* | 519 | seqidno88; PRT; *Oryza sativa* | 520 |
| seqidno89; DNA; *Oryza sativa* | 521 | seqidno90; PRT; *Oryza sativa* | 522 |
| seqidno91; DNA; *Oryza sativa* | 523 | seqidno92; PRT; *Oryza sativa* | 524 |
| seqidno93; DNA; *Oryza sativa* | 525 | seqidno94; PRT; *Oryza sativa* | 526 |
| seqidno95; DNA; *Oryza sativa* | 527 | seqidno96; PRT; *Oryza sativa* | 528 |
| seqidno97; DNA; *Oryza sativa* | 529 | seqidno98; PRT; *Oryza sativa* | 530 |
| seqidno99; DNA; *Oryza sativa* | 531 | seqidno100; PRT; *Oryza sativa* | 532 |
| seqidno101; DNA; *Oryza sativa* | 533 | seqidno102; PRT; *Oryza sativa* | 534 |
| seqidno103; DNA; *Oryza sativa* | 535 | seqidno104; PRT; *Oryza sativa* | 536 |
| seqidno105; DNA; *Oryza sativa* | 537 | seqidno106; PRT; *Oryza sativa* | 538 |
| seqidno107; DNA; *Oryza sativa* | 539 | seqidno108; PRT; *Oryza sativa* | 540 |
| seqidno109; DNA; *Oryza sativa* | 541 | seqidno110; PRT; *Oryza sativa* | 542 |
| seqidno111; DNA; *Oryza sativa* | 543 | seqidno112; PRT; *Oryza sativa* | 544 |
| seqidno113; DNA; *Oryza sativa* | 545 | seqidno114; PRT; *Oryza sativa* | 546 |
| seqidno115; DNA; *Oryza sativa* | 547 | seqidno116; PRT; *Oryza sativa* | 548 |
| seqidno117; DNA; *Oryza sativa* | 549 | seqidno118; PRT; *Oryza sativa* | 550 |
| seqidno119; DNA; *Oryza sativa* | 551 | seqidno120; PRT; *Oryza sativa* | 552 |
| seqidno121; DNA; *Oryza sativa* | 553 | seqidno122; PRT; *Oryza sativa* | 554 |
| seqidno123; DNA; *Oryza sativa* | 555 | seqidno124; PRT; *Oryza sativa* | 556 |
| seqidno125; DNA; *Oryza sativa* | 557 | seqidno126; PRT; *Oryza sativa* | 558 |
| seqidno127; DNA; *Oryza sativa* | 559 | seqidno128; PRT; *Oryza sativa* | 560 |
| seqidno129; DNA; *Oryza sativa* | 561 | seqidno130; PRT; *Oryza sativa* | 562 |
| seqidno131; DNA; *Oryza sativa* | 563 | seqidno132; PRT; *Oryza sativa* | 564 |
| seqidno133; DNA; *Oryza sativa* | 565 | seqidno134; PRT; *Oryza sativa* | 566 |
| seqidno135; DNA; *Oryza sativa* | 567 | seqidno136; PRT; *Oryza sativa* | 568 |
| seqidno137; DNA; *Oryza sativa* | 569 | seqidno138; PRT; *Oryza sativa* | 570 |
| seqidno139; DNA; *Oryza sativa* | 571 | seqidno140; PRT; *Oryza sativa* | 572 |
| seqidno141; DNA; *Oryza sativa* | 573 | seqidno142; PRT; *Oryza sativa* | 574 |
| seqidno143; DNA; *Oryza sativa* | 575 | seqidno144; PRT; *Oryza sativa* | 576 |
| seqidno145; DNA; *Oryza sativa* | 577 | seqidno146; PRT; *Oryza sativa* | 578 |
| seqidno147; DNA; *Oryza sativa* | 579 | seqidno148; PRT; *Oryza sativa* | 580 |
| seqidno149; DNA; *Oryza sativa* | 581 | seqidno150; PRT; *Oryza sativa* | 582 |

-continued

| Nucleic acid name | Nucleic Acid SEQ ID NO: | Polypeptide name | Polypeptide SEQ ID NO: |
|---|---|---|---|
| seqidno151; DNA; *Oryza sativa* | 583 | seqidno152; PRT; *Oryza sativa* | 584 |
| seqidno153; DNA; *Oryza sativa* | 585 | seqidno154; PRT; *Oryza sativa* | 586 |
| seqidno155; DNA; *Oryza sativa* | 587 | seqidno156; PRT; *Oryza sativa* | 588 |
| seqidno157; DNA; *Oryza sativa* | 589 | seqidno158; PRT; *Oryza sativa* | 590 |
| seqidno159; DNA; *Oryza sativa* | 591 | seqidno160; PRT; *Oryza sativa* | 592 |
| seqidno161; DNA; *Oryza sativa* | 593 | seqidno162; PRT; *Oryza sativa* | 594 |
| seqidno163; DNA; *Oryza sativa* | 595 | seqidno164; PRT; *Oryza sativa* | 596 |
| seqidno165; DNA; *Oryza sativa* | 597 | seqidno166; PRT; *Oryza sativa* | 598 |
| seqidno167; DNA; *Oryza sativa* | 599 | seqidno168; PRT; *Oryza sativa* | 600 |
| seqidno169; DNA; *Oryza sativa* | 601 | seqidno170; PRT; *Oryza sativa* | 602 |
| seqidno171; DNA; *Oryza sativa* | 603 | seqidno172; PRT; *Oryza sativa* | 604 |
| seqidno173; DNA; *Oryza sativa* | 605 | seqidno174; PRT; *Oryza sativa* | 606 |
| seqidno175; DNA; *Oryza sativa* | 607 | seqidno176; PRT; *Oryza sativa* | 608 |
| seqidno177; DNA; *Oryza sativa* | 609 | seqidno178; PRT; *Oryza sativa* | 610 |
| seqidno179; DNA; *Oryza sativa* | 611 | seqidno180; PRT; *Oryza sativa* | 612 |
| seqidno181; DNA; *Oryza sativa* | 613 | seqidno182; PRT; *Oryza sativa* | 614 |
| seqidno183; DNA; *Oryza sativa* | 615 | seqidno184; PRT; *Oryza sativa* | 616 |
| seqidno185; DNA; *Oryza sativa* | 617 | seqidno186; PRT; *Oryza sativa* | 618 |
| seqidno187; DNA; *Oryza sativa* | 619 | seqidno188; PRT; *Oryza sativa* | 620 |
| seqidno189; DNA; *Oryza sativa* | 621 | seqidno190; PRT; *Oryza sativa* | 622 |
| seqidno191; DNA; *Oryza sativa* | 623 | seqidno192; PRT; *Oryza sativa* | 624 |
| seqidno193; DNA; *Oryza sativa* | 625 | seqidno194; PRT; *Oryza sativa* | 626 |
| seqidno195; DNA; *Zea mays* | 627 | seqidno196; PRT; *Zea mays* | 628 |
| seqidno197; DNA; *Zea mays* | 629 | seqidno198; PRT; *Zea mays* | 630 |
| seqidno199; DNA; *Zea mays* | 631 | seqidno200; PRT; *Zea mays* | 632 |
| seqidno201; DNA; *Zea mays* | 633 | seqidno202; PRT; *Zea mays* | 634 |
| seqidno203; DNA; *Zea mays* | 635 | seqidno204; PRT; *Zea mays* | 636 |
| seqidno205; DNA; *Zea mays* | 637 | seqidno206; PRT; *Zea mays* | 638 |
| seqidno207; DNA; *Zea mays* | 639 | seqidno208; PRT; *Zea mays* | 640 |
| seqidno209; DNA; *Zea mays* | 641 | seqidno210; PRT; *Zea mays* | 642 |
| seqidno211; DNA; *Zea mays* | 643 | seqidno212; PRT; *Zea mays* | 644 |
| seqidno213; DNA; *Zea mays* | 645 | seqidno214; PRT; *Zea mays* | 646 |
| seqidno215; DNA; *Zea mays* | 647 | seqidno216; PRT; *Zea mays* | 648 |
| seqidno217; DNA; *Zea mays* | 649 | seqidno218; PRT; *Zea mays* | 650 |
| seqidno219; DNA; *Zea mays* | 651 | seqidno220; PRT; *Zea mays* | 652 |
| seqidno221; DNA; *Zea mays* | 653 | seqidno222; PRT; *Zea mays* | 654 |
| seqidno223; DNA; *Zea mays* | 655 | seqidno224; PRT; *Zea mays* | 656 |
| seqidno225; DNA; *Zea mays* | 657 | seqidno226; PRT; *Zea mays* | 658 |
| seqidno227; DNA; *Zea mays* | 659 | seqidno228; PRT; *Zea mays* | 660 |
| seqidno229; DNA; *Zea mays* | 661 | seqidno230; PRT; *Zea mays* | 662 |
| seqidno231; DNA; *Zea mays* | 663 | seqidno232; PRT; *Zea mays* | 664 |
| seqidno233; DNA; *Zea mays* | 665 | seqidno234; PRT; *Zea mays* | 666 |
| seqidno673; DNA; *Populus trichocarpa* | 673 | seqidno674; PRT; *Populus trichocarpa* | 674 |
| seqidno675; DNA; *Populus trichocarpa* | 675 | seqidno676; PRT; *Populus trichocarpa* | 676 |
| seqidno677; DNA; *Populus trichocarpa* | 677 | seqidno678; PRT; *Populus trichocarpa* | 678 |
| seqidno679; DNA; *Populus trichocarpa* | 679 | seqidno680; PRT; *Populus trichocarpa* | 680 |
| seqidno681; DNA; *Populus trichocarpa* | 681 | seqidno682; PRT; *Populus trichocarpa* | 682 |
| seqidno683; DNA; *Populus trichocarpa* | 683 | seqidno684; PRT; *Populus trichocarpa* | 684 |
| seqidno685; DNA; *Populus trichocarpa* | 685 | seqidno686; PRT; *Populus trichocarpa* | 686 |
| seqidno687; DNA; *Populus trichocarpa* | 687 | seqidno688; PRT; *Populus trichocarpa* | 688 |
| seqidno689; DNA; *Populus trichocarpa* | 689 | seqidno690; PRT; *Populus trichocarpa* | 690 |
| seqidno691; DNA; *Populus trichocarpa* | 691 | seqidno692; PRT; *Populus trichocarpa* | 692 |
| seqidno693; DNA; *Populus trichocarpa* | 693 | seqidno694; PRT; *Populus trichocarpa* | 694 |
| seqidno695; DNA; *Populus trichocarpa* | 695 | seqidno696; PRT; *Populus trichocarpa* | 696 |
| seqidno697; DNA; *Populus trichocarpa* | 697 | seqidno698; PRT; *Populus trichocarpa* | 698 |
| seqidno699; DNA; *Populus trichocarpa* | 699 | seqidno700; PRT; *Populus trichocarpa* | 700 |
| seqidno701; DNA; *Populus trichocarpa* | 701 | seqidno702; PRT; *Populus trichocarpa* | 702 |
| seqidno703; DNA; *Populus trichocarpa* | 703 | seqidno704; PRT; *Populus trichocarpa* | 704 |
| seqidno705; DNA; *Populus trichocarpa* | 705 | seqidno706; PRT; *Populus trichocarpa* | 706 |
| seqidno707; DNA; *Populus trichocarpa* | 707 | seqidno708; PRT; *Populus trichocarpa* | 708 |
| seqidno709; DNA; *Populus trichocarpa* | 709 | seqidno710; PRT; *Populus trichocarpa* | 710 |
| seqidno711; DNA; *Populus trichocarpa* | 711 | seqidno712; PRT; *Populus trichocarpa* | 712 |
| seqidno713; DNA; *Populus trichocarpa* | 713 | seqidno714; PRT; *Populus trichocarpa* | 714 |
| seqidno715; DNA; *Populus trichocarpa* | 715 | seqidno716; PRT; *Populus trichocarpa* | 716 |
| seqidno717; DNA; *Populus trichocarpa* | 717 | seqidno718; PRT; *Populus trichocarpa* | 718 |
| seqidno719; DNA; *Populus trichocarpa* | 719 | seqidno720; PRT; *Populus trichocarpa* | 720 |
| seqidno721; DNA; *Populus trichocarpa* | 721 | seqidno722; PRT; *Populus trichocarpa* | 722 |
| seqidno723; DNA; *Populus trichocarpa* | 723 | seqidno724; PRT; *Populus trichocarpa* | 724 |
| seqidno725; DNA; *Populus trichocarpa* | 725 | seqidno726; PRT; *Populus trichocarpa* | 726 |
| seqidno727; DNA; *Populus trichocarpa* | 727 | seqidno728; PRT; *Populus trichocarpa* | 728 |
| seqidno729; DNA; *Populus trichocarpa* | 729 | seqidno730; PRT; *Populus trichocarpa* | 730 |
| seqidno731; DNA; *Populus trichocarpa* | 731 | seqidno732; PRT; *Populus trichocarpa* | 732 |
| seqidno733; DNA; *Populus trichocarpa* | 733 | seqidno734; PRT; *Populus trichocarpa* | 734 |
| seqidno735; DNA; *Populus trichocarpa* | 735 | seqidno736; PRT; *Populus trichocarpa* | 736 |

1.5. IAA14 Polypeptides

Table A5 provides a list of nucleic acid sequences related to the nucleic acid sequence used in the methods of the present invention.

TABLE A5

Examples of IAA14-like polypeptides:

| Plant Source | Name | Polypeptide SEQ ID NO: | Nucleic acid SEQ ID NO: |
|---|---|---|---|
| *Arabidopsis thaliana* | AT4G14550.1#1 | 738 | 737 |
| *Arabidopsis thaliana* | AT3G23050.1#1 | 748 | 783 |
| *Arabidopsis thaliana* | AT3G23050.2#1 | 749 | 784 |
| *Populus trichocarpa* | 566151#1 | 750 | 785 |
| *Populus trichocarpa* | 720961#1 | 751 | 786 |
| *Medicago truncatula* | TA20354_3880#1 | 752 | 787 |
| *Solanum lycopersicum* | TA40922_4081#1 | 753 | 788 |
| *Arabidopsis thaliana* | AT1G04250.1#1 | 754 | 789 |
| *Oryza sativa* | CB657009#1 | 755 | 790 |
| *Oryza sativa* | TA41733_4530#1 | 756 | 791 |
| *Medicago truncatula* | TA20951_3880#1 | 757 | 792 |
| *Arabidopsis thaliana* | AT3G04730.1#1 | 758 | 793 |
| *Solanum lycopersicum* | TA48108_4081#1 | 759 | 794 |
| *Medicago truncatula* | TA27011_3880#1 | 760 | 795 |
| *Medicago truncatula* | TA22814_3880#1 | 761 | 796 |
| *Populus trichocarpa* | 643213#1 | 762 | 797 |
| *Arabidopsis thaliana* | AT3G23030.1#1 | 763 | 798 |
| *Arabidopsis thaliana* | AT4G14560.1#1 | 764 | 799 |
| *Arabidopsis thaliana* | AT1G04240.1#1 | 765 | 800 |
| *Solanum lycopersicum* | TA38817_4081#1 | 766 | 801 |
| *Solanum lycopersicum* | TA43058_4081#1 | 767 | 802 |
| *Populus trichocarpa* | 726443#1 | 768 | 803 |
| *Populus trichocarpa* | 564913#1 | 769 | 804 |
| *Populus trichocarpa* | 831610#1 | 770 | 805 |
| *Populus trichocarpa* | 798526#1 | 771 | 806 |
| *Medicago truncatula* | TA20557_3880#1 | 772 | 807 |
| *Medicago truncatula* | TA20558_3880#1 | 773 | 808 |
| *Populus trichocarpa* | 823671#1 | 774 | 809 |
| *Populus trichocarpa* | 595419#1 | 775 | 810 |
| *Medicago truncatula* | TA31746_3880#1 | 776 | 811 |
| *Solanum lycopersicum* | TA42190_4081#1 | 777 | 812 |
| *Arabidopsis thaliana* | AT4G29080.1#1 | 778 | 813 |
| *Medicago truncatula* | TA25400_3880#1 | 779 | 814 |
| *Populus trichocarpa* | 711734#1 | 780 | 815 |
| *Populus trichocarpa* | 584053#1 | 781 | 816 |
| *Medicago truncatula* | TA23062_3880#1 | 782 | 817 |

In some instances, related sequences have tentatively been assembled and publicly disclosed by research institutions, such as The Institute for Genomic Research (TIGR). The Eukaryotic Gene Orthologs (EGO) database may be used to identify such related sequences, either by keyword search or by using the BLAST algorithm with the nucleic acid or polypeptide sequence of interest.

Example 2

Alignment of Sequences Related to the Polypeptide Sequences Used in the Methods of the Invention 2.1. Aspartate AminoTransferase (ASPAT)

Alignment of polypeptide sequences was performed using the ClustalW 2.0 algorithm of progressive alignment (Thompson et al. (1997) Nucleic Acids Res 25:4876-4882; Chema et al. (2003). Nucleic Acids Res 31:3497-3500) with standard setting (slow alignment, similarity matrix: Gonnet (or Blosum 62 (if polypeptides are aligned), gap opening penalty 10, gap extension penalty: 0.2). Minor manual editing was done to further optimise the alignment. The ASPAT polypeptides are aligned in FIG. 1.

Figure 2:
FIG. 2 shows a phylogenetic tree of ASPAT polypeptides.

A phylogenetic tree of ASPAT polypeptides (FIG. 2) was constructed using a neighbour-joining clustering algorithm as provided in the AlignX programme from the Vector NTI (Invitrogen). The polypeptides clustered in five major phylogenetic classes, class 1, class 2, class 3, class 4, and class 5. Table B1 shows the polypeptides found within each of the five classes. The polypeptides of Class 5 were used as an outgroup in the phylogenetic analysis and do not represent ASPAT polypeptides. Therefore polypeptides of Class 5 are not part of the invention herein described. Polypeptides within class 1 and 2 are typically expressed in the cytosol or the chloroplast. Class 5 corresponds to the new class of ASAPT polypeptides defined by De La Torre et al. 2006. Polypeptides within class 4 are typically expressed in the mitochondria.

TABLE B1

Phylogenetic classes of ASPAT polypeptides.

| Name | Nucleic acid SEQ ID NO: | Amino acid SEQ ID NO: | Phylogenetic class |
|---|---|---|---|
| O. sativa_Os01g0760600 | 1 | 2 | 1 |
| O. sativa_Os01g0760600-truncated | 3 | 4 | 1 |
| A. thaliana_AT5G19550 | 5 | 6 | 1 |
| A. thaliana_AT5G11520 | 7 | 8 | 1 |
| A. thaliana_AT4G31990 | 9 | 10 | 1 |
| A. thaliana_AT1G62800 | 11 | 12 | 1 |
| B. napus_TA23207 | 13 | 14 | 1 |
| B. napus_TA23768 | 15 | 16 | 1 |
| C. sinensis_TA12564 | 17 | 18 | 1 |
| C. solstitialis_TA659 | 19 | 20 | 1 |
| G. hirsutum_TA23799 | 21 | 22 | 1 |
| G. max_AF034210 | 23 | 24 | 1 |
| G. raimondii_TA9413 | 25 | 26 | 1 |
| H. annuus_TA8926 | 27 | 28 | 1 |
| H. paradoxus_TA2606 | 29 | 30 | 1 |
| J. regia_TA762 | 31 | 32 | 1 |
| L. japonicus_TA1537 | 33 | 34 | 1 |
| L. perennis_TA512 | 35 | 36 | 1 |
| L. perennis_TA605 | 37 | 38 | 1 |
| N. tabacum_TA13125 | 39 | 40 | 1 |
| P. glauca_TA15326 | 41 | 42 | 1 |
| P. patens_136815 | 43 | 44 | 1 |
| P. persica_TA3273 | 45 | 46 | 1 |
| P. sitchensis_TA22265 | 47 | 48 | 1 |
| P. trichocarpa_819551 | 49 | 50 | 1 |
| P. trifoliata_TA8305 | 51 | 52 | 1 |
| S. lycopersicum_TA38054 | 53 | 54 | 1 |
| S. officinarum_TA26595 | 55 | 56 | 1 |
| T. aestivum_TA52678 | 57 | 58 | 1 |
| V. carteri_82929 | 59 | 60 | 1 |
| V. vinifera_GSVIVT00016723001 | 61 | 62 | 1 |
| V. vinifera_GSVIVT00032463001 | 63 | 64 | 1 |
| Z. mays_TA9042 | 65 | 66 | 1 |
| C. reinhardtii_186959 | 67 | 68 | 2 |
| C. solstitialis_TA2275 | 69 | 70 | 2 |
| C. tinctorius_TA12 | 71 | 72 | 2 |
| G. hirsutum_TA24406 | 73 | 74 | 2 |
| G. max_TA61768 | 75 | 76 | 2 |
| G. raimondii_TA9928 | 77 | 78 | 2 |
| H. exilis_TA1663 | 79 | 80 | 2 |
| H. vulgare_BPS_7992 | 81 | 82 | 2 |
| L. japonicus_TA1466 | 83 | 84 | 2 |
| M. polymorpha_TA825 | 85 | 86 | 2 |
| N. tabacum_TA13015 | 87 | 88 | 2 |
| O. sativa_Os02g0797500 | 89 | 90 | 2 |
| P. glauca_TA14780 | 91 | 92 | 2 |
| P. patens_102134 | 93 | 94 | 2 |
| P. sitchensis_TA20968 | 95 | 96 | 2 |
| P. taeda_TA6616 | 97 | 98 | 2 |
| P. trichocarpa_654206 | 99 | 100 | 2 |
| P. trichocarpa_835828 | 101 | 102 | 2 |
| P. vulgaris_TA4043 | 103 | 104 | 2 |
| S. tuberosum_TA23192 | 105 | 106 | 2 |
| V. carteri_81153 | 107 | 108 | 2 |
| V. vinifera_GSVIVT00032723001 | 109 | 110 | 2 |
| Z. mays_TA10886 | 111 | 112 | 2 |
| A. thaliana_AT2G30970 | 113 | 114 | 4 |
| C. sinensis_TA15250 | 115 | 116 | 4 |

TABLE B1-continued

| Phylogenetic classes of ASPAT polypeptides. | | | |
|---|---|---|---|
| Name | Nucleic acid SEQ ID NO: | Amino acid SEQ ID NO: | Phylo-genetic class |
| G. max_TA50178 | 117 | 118 | 4 |
| G. raimondii_TA9985 | 119 | 120 | 4 |
| H. vulgare_TA32835 | 121 | 122 | 4 |
| H. vulgare_TA36301 | 123 | 124 | 4 |
| O. lucimarinus_31597 | 125 | 126 | 4 |
| O. sativa_Os02g0236000 | 127 | 128 | 4 |
| O. sativa_Os06g0548000 | 129 | 130 | 4 |
| O. taurii_32764 | 131 | 132 | 4 |
| P. patens_169868 | 133 | 134 | 4 |
| P. sitchensis_TA23007 | 135 | 136 | 4 |
| P. taeda_TA7145 | 137 | 138 | 4 |
| V. vinifera_GSVIVT00018772001 | 139 | 140 | 4 |
| V. vinifera_GSVIVT00037462001 | 141 | 142 | 4 |
| A. anophagefferens_21970 | 143 | 144 | 3 |
| A. thaliana_AT2G22250.2 | 145 | 146 | 3 |
| B. napus_BPS_9867 | 147 | 148 | 3 |
| C. reinhardtii_118364 | 149 | 150 | 3 |
| G. hirsutum_TA27281 | 151 | 152 | 3 |
| G. max_BPS_36342 | 153 | 154 | 3 |
| H. vulgare_TA28738 | 155 | 156 | 3 |
| M. domestica_TA26867 | 157 | 158 | 3 |
| N. tabacum_TA15308 | 159 | 160 | 3 |
| O. basilicum_TA1043 | 161 | 162 | 3 |
| O. sativa_Os01g0871300 | 163 | 164 | 3 |
| P. patens_127152 | 165 | 166 | 3 |
| P. pinaster_TA3616_71647 | 167 | 168 | 3 |
| P. trichocarpa_scaff_V.183 | 169 | 170 | 3 |
| P. trichocarpa_scaff_VII.574 | 171 | 172 | 3 |
| S. lycopersicum_TA37592 | 173 | 174 | 3 |
| S. tuberosum_TA27739 | 175 | 176 | 3 |
| T. aestivum_TA71539 | 177 | 178 | 3 |
| V. carteri_103084 | 179 | 180 | 3 |
| V. vinifera_GSVIVT00019453001 | 181 | 182 | 3 |
| Z. mays_BPS_26636 | 183 | 184 | 3 |
| Z. mays_BPS_4233 | 185 | 186 | 3 |
| A. anophagefferens_21841 | 187 | 188 | 5 |
| A. anophagefferens_27031 | 189 | 190 | 5 |
| A. anophagefferens_27395 | 191 | 192 | 5 |
| A. anophagefferens_58638 | 193 | 194 | 5 |
| E. huxleyi_413787 | 195 | 196 | 5 |
| E. huxleyi_437487 | 197 | 198 | 5 |
| E. huxleyi_467854 | 199 | 200 | 5 |
| P. tricornutum_23059 | 201 | 202 | 5 |
| P. tricornutum_23871 | 203 | 204 | 5 |
| T. pseudonana_269248 | 205 | 206 | 5 |

Alignment of polypeptide sequences was performed using the ClustalW 2.0 algorithm of progressive alignment (Thompson et al. (1997) Nucleic Acids Res 25:4876-4882; Chema et al. (2003). Nucleic Acids Res 31:3497-3500) with standard setting (slow alignment, similarity matrix: Gonnet, gap opening penalty 10, gap extension penalty: 0.2). Minor manual editing was done to further optimise the alignment.

2.2. MYB91 Like Transcription Factor (MYB91)

Multiple sequence alignment of all the MYB91 polypeptide sequences in Table A2 was performed using the ClustalW 1.81 algorithm. Results of the alignment are shown in FIG. 5 of the present application. Two MYB DNA binding domains with an InterPro accession number IPR014778, a MYB transcription factor with an InterPro accession number IPR015495, and a C-terminal Conserved Domain, are marked with X's below the consensus sequence.

2.3. Gibberellic Acid-Stimulated *Arabidopsis* (GASA)

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chema et al. (2003). Nucleic Acids Res 31:3497-3500). Default values are for the gap open penalty of 10, for the gap extension penalty of 0.1 and the selected weight matrix is Blosum 62 (if polypeptides are aligned). Minor manual editing was done to further optimise the alignment. Sequence conservation among GASA polypeptides is essentially in the C-terminal part of the polypeptides, the N-terminal part usually being more variable in sequence length and composition. The GASA polypeptides are aligned in FIG. 8.

2.4. Auxin/Indoleacetic Acid Genes (AUX/IAA)

Alignment of polypeptide sequences was performed using the AlignX programme from the Vector NTI (Invitrogen), which is based on the ClustalW 2.0 algorithm for progressive alignment (Thompson et al. (1997) Nucleic Acids Res 25:4876-4882; Chema et al. (2003). Nucleic Acids Res 31:3497-3500); Alignment was performed with standard settings: gap opening penalty 10, gap extension penalty: 0.2. Minor manual editing was done to further optimise the alignment. The AUX/IAA polypeptides are aligned (FIG. 11).

Highly conserved amino acid residues are indicated in the consensus sequence.

2.5. IAA14 Polypeptides

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chema et al. (2003). Nucleic Acids Res 31:3497-3500). Default values are for the gap open penalty of 10, for the gap extension penalty of 0.1 and the selected weight matrix is Blosum 62 (if polypeptides are aligned). Minor manual editing was done to further optimise the alignment. Sequence conservation among IAA14-like polypeptides is essentially in the C-terminal half of the polypeptides. The IAA14-like polypeptides are aligned in FIG. 14.

Example 3

Calculation of Global Percentage Identity Between Polypeptide Sequences Useful in Performing the Methods of the Invention 3.1. Aspartate AminoTransferase (ASPAT)

Global percentages of similarity and identity between full length polypeptide sequences useful in performing the methods of the invention are determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

A MATGAT table for local alignment of a specific domain, or data on % identity/similarity between specific domains may also be generated.

3.2. MYB91 Like Transcription Factor (MYB91)

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table C1 for the global similarity and identity over the full length of the polypeptide sequences (excluding the partial polypeptide sequences).

The percentage identity between the full length polypeptide sequences useful in performing the methods of the invention can be as low as 52% amino acid identity compared to SEQ ID NO: 221.

The percentage amino acid identity can be significantly increased if the most conserved region of the polypeptides are compared. For example, when comparing the amino acid sequence of a MYB DNA transcription factor with an InterPro entry IPR015495 as represented by SEQ ID NO: 268, or of a MYB DNA binding domain with an InterPro accession number IPR014778 as represented by SEQ ID NO: 269 and/or 270, or of a C-terminal conserved domain as represented by SEQ ID NO: 271 with the respective corresponding domains of the polypeptides of Table A1, the percentage amino acid identity increases significantly (in order of preference at least 50%, 55%, 60%, 65%, 70%, 75%, 80%, 85%, 90%, 95%, 98%, 99% or more amino acid sequence identity).

3.3. Gibberellic Acid-Stimulated *Arabidopsis* (GASA)

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table C2 for the global similarity and identity over the full length of the polypeptide sequences. Percentage identity is given above the diagonal and percentage similarity is given below the diagonal.

The percentage identity between the GASA polypeptide sequences useful in performing the methods of the invention can be as low as 22.2% amino acid identity compared to SEQ ID NO: 276.

TABLE C1

MatGAT results for global similarity and identity over the full length of the polypeptide sequences of Table A.

| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 |
|---|---|---|---|---|---|---|---|---|---|---|---|---|---|---|---|---|---|---|---|---|---|---|---|
| 1. Antma_MYB91 | | 72 | 64 | 64 | 63 | 68 | 69 | 70 | 64 | 70 | 66 | 59 | 71 | 73 | 67 | 48 | 73 | 57 | 68 | 71 | 70 | 73 | 58 |
| 2. Aqufo_MYB91 | 84 | | 70 | 68 | 69 | 79 | 74 | 73 | 69 | 76 | 71 | 62 | 76 | 77 | 72 | 50 | 76 | 58 | 73 | 78 | 75 | 83 | 58 |
| 3. Arath_MYB91 | 77 | 80 | | 86 | 91 | 64 | 66 | 66 | 61 | 67 | 63 | 59 | 68 | 67 | 66 | 48 | 68 | 52 | 66 | 71 | 67 | 71 | 54 |
| 4. Brana_MYB91 | 76 | 80 | 92 | | 85 | 63 | 67 | 64 | 62 | 66 | 63 | 59 | 67 | 66 | 65 | 47 | 67 | 52 | 65 | 70 | 66 | 69 | 53 |
| 5. Carhi_MYB91 | 77 | 81 | 94 | 91 | | 64 | 65 | 64 | 60 | 66 | 62 | 58 | 67 | 66 | 65 | 47 | 67 | 50 | 65 | 69 | 67 | 69 | 52 |
| 6. Escca_MYB91 | 80 | 86 | 79 | 77 | 78 | | 70 | 71 | 68 | 72 | 69 | 60 | 72 | 76 | 71 | 50 | 73 | 57 | 71 | 73 | 72 | 79 | 56 |
| 7. Eucgr_MYB91 | 82 | 87 | 80 | 80 | 79 | 83 | | 73 | 68 | 72 | 71 | 64 | 74 | 77 | 71 | 50 | 75 | 54 | 72 | 76 | 74 | 79 | 57 |
| 8. Glyma_MYB91(a) | 80 | 84 | 79 | 78 | 78 | 81 | 84 | | 77 | 73 | 76 | 67 | 73 | 76 | 89 | 49 | 74 | 55 | 88 | 76 | 72 | 80 | 57 |
| 9. Glyma_MYB91(b) | 77 | 82 | 76 | 77 | 75 | 78 | 82 | 84 | | 69 | 73 | 71 | 67 | 70 | 77 | 51 | 68 | 52 | 76 | 72 | 67 | 74 | 55 |
| 10. Goshi_MYB91 | 80 | 87 | 81 | 80 | 79 | 83 | 85 | 83 | 82 | | 72 | 62 | 73 | 77 | 73 | 49 | 73 | 55 | 74 | 79 | 72 | 82 | 54 |
| 11. Lotco_MYB91(a) | 77 | 83 | 77 | 77 | 77 | 80 | 84 | 84 | 84 | 83 | | 69 | 70 | 73 | 76 | 51 | 72 | 55 | 75 | 73 | 71 | 75 | 56 |
| 12. Lotco_MYB91(b) | 72 | 75 | 72 | 71 | 71 | 72 | 78 | 78 | 80 | 75 | 80 | | 62 | 65 | 68 | 46 | 64 | 50 | 68 | 65 | 62 | 66 | 51 |
| 13. Lyces_MYB91 | 82 | 87 | 81 | 80 | 81 | 86 | 86 | 83 | 80 | 83 | 81 | 75 | | 76 | 72 | 49 | 92 | 56 | 73 | 75 | 98 | 80 | 55 |
| 14. Maldo_MYB91 | 84 | 87 | 79 | 81 | 78 | 84 | 88 | 85 | 83 | 86 | 84 | 79 | 86 | | 74 | 50 | 77 | 58 | 74 | 79 | 76 | 84 | 58 |
| 15. Medtr_MYB91 | 78 | 84 | 79 | 78 | 78 | 82 | 83 | 93 | 85 | 83 | 86 | 79 | 83 | 84 | | 49 | 72 | 55 | 96 | 76 | 71 | 78 | 57 |
| 16. Moral_MYB91 | 63 | 64 | 64 | 65 | 64 | 63 | 65 | 63 | 63 | 62 | 63 | 59 | 63 | 62 | 62 | | 49 | 46 | 49 | 52 | 49 | 50 | 44 |
| 17. Nicta_MYB91 | 83 | 87 | 80 | 80 | 79 | 84 | 86 | 84 | 81 | 83 | 80 | 76 | 95 | 86 | 82 | 63 | | 55 | 73 | 76 | 92 | 81 | 56 |
| 18. Orysa_MYB91 | 75 | 75 | 71 | 71 | 69 | 74 | 74 | 70 | 71 | 74 | 73 | 71 | 73 | 75 | 71 | 62 | 72 | | 56 | 54 | 55 | 57 | 62 |
| 19. Pissa_MYB91 | 79 | 85 | 80 | 79 | 78 | 82 | 83 | 92 | 85 | 83 | 85 | 79 | 83 | 84 | 98 | 63 | 83 | 72 | | 76 | 72 | 79 | 57 |
| 20. Poptr_MYB91 | 81 | 87 | 83 | 82 | 81 | 84 | 87 | 86 | 82 | 87 | 83 | 75 | 87 | 87 | 85 | 65 | 87 | 73 | 85 | | 74 | 86 | 56 |
| 21. Soltu_MYB91 | 83 | 86 | 80 | 80 | 80 | 85 | 86 | 82 | 80 | 82 | 83 | 75 | 98 | 86 | 82 | 64 | 95 | 72 | 82 | 86 | | 80 | 55 |
| 22. Vitvi_MYB91 | 84 | 91 | 83 | 82 | 82 | 88 | 89 | 88 | 84 | 90 | 85 | 77 | 88 | 90 | 87 | 64 | 89 | 75 | 87 | 93 | 88 | | 59 |
| 23. Zeama_MYB91 | 73 | 71 | 71 | 70 | 69 | 70 | 72 | 73 | 70 | 70 | 71 | 65 | 71 | 71 | 71 | 64 | 72 | 73 | 71 | 73 | 70 | 71 | |

TABLE C2

MatGAT results for global similarity and identity over the full length of the polypeptide sequences.

| | 1 | 2 | 3 | 4 | 5 | 6 | 7 | 8 | 9 | 10 | 11 | 12 | 13 |
|---|---|---|---|---|---|---|---|---|---|---|---|---|---|
| 1. TA5035_4679 | | 42.0 | 35.5 | 27.6 | 35.0 | 29.9 | 35.9 | 52.1 | 33.0 | 28.2 | 35.9 | 64.3 | 36.6 |
| 2. TA5923_4679 | 52.1 | | 48.0 | 34.2 | 35.6 | 32.0 | 33.3 | 47.1 | 31.1 | 28.1 | 33.3 | 40.8 | 36.1 |
| 3. Os05g0376800 | 40.8 | 55.9 | | 28.8 | 26.7 | 28.4 | 27.6 | 38.6 | 23.2 | 26.6 | 27.6 | 34.2 | 23.9 |
| 4. Os04g0465300 | 37.1 | 47.1 | 40.1 | | 24.2 | 33.1 | 37.4 | 28.8 | 30.6 | 35.1 | 37.4 | 29.5 | 33.0 |
| 5. Os10g0115550 | 42.7 | 49.6 | 42.1 | 35.0 | | 30.7 | 33.3 | 34.6 | 23.7 | 29.4 | 32.5 | 36.8 | 30.5 |
| 6. AK105729 | 34.2 | 42.0 | 38.8 | 45.3 | 49.6 | | 34.2 | 32.8 | 42.0 | 33.1 | 34.2 | 29.1 | 79.5 |
| 7. Os05g0432200 | 44.6 | 44.5 | 34.9 | 47.6 | 47.0 | 48.7 | | 33.3 | 37.9 | 34.0 | 98.9 | 38.0 | 42.1 |
| 8. Os09g0414900 | 57.3 | 57.1 | 48.7 | 43.6 | 55.6 | 41.9 | 41.0 | | 29.2 | 31.1 | 33.3 | 47.0 | 35.0 |
| 9. Os03g0607200 | 41.5 | 42.0 | 30.9 | 38.1 | 37.6 | 52.1 | 52.1 | 40.2 | | 37.7 | 37.9 | 31.9 | 52.6 |
| 10. Os07g0592000 | 38.2 | 37.8 | 33.6 | 47.6 | 40.2 | 42.7 | 43.1 | 41.0 | 53.9 | | 34.0 | 31.1 | 40.0 |
| 11. AK110640 | 43.5 | 44.5 | 34.9 | 47.6 | 46.2 | 48.7 | 98.9 | 41.0 | 52.1 | 43.1 | | 38.0 | 42.1 |
| 12. Os06g0266800 | 73.8 | 46.2 | 38.2 | 36.2 | 44.4 | 30.8 | 44.6 | 53.0 | 40.4 | 36.3 | 43.5 | | 35.4 |
| 13. Os03g0760800 | 43.0 | 46.2 | 31.6 | 46.7 | 44.4 | 79.5 | 59.1 | 41.0 | 64.9 | 51.0 | 59.1 | 40.9 | |
| 14. scaff_205.30 | 41.2 | 43.7 | 38.2 | 49.5 | 39.3 | 47.9 | 46.1 | 47.9 | 52.9 | 53.9 | 46.1 | 37.3 | 55.9 |
| 15. scaff_II.204 | 35.6 | 45.4 | 37.5 | 53.3 | 42.7 | 49.6 | 60.4 | 42.7 | 48.5 | 46.1 | 59.4 | 37.6 | 56.4 |
| 16. scaff_II.2330 | 46.3 | 52.1 | 45.4 | 43.0 | 52.1 | 43.0 | 38.0 | 48.8 | 33.9 | 35.5 | 38.0 | 43.0 | 38.0 |
| 17. scaff_VI.397 | 60.0 | 62.2 | 49.3 | 48.6 | 49.6 | 45.3 | 43.0 | 54.7 | 43.0 | 41.2 | 42.0 | 59.0 | 48.0 |
| 18. scf_XVII.377 | 63.6 | 55.5 | 48.0 | 45.8 | 50.4 | 40.2 | 44.9 | 64.1 | 41.1 | 46.7 | 43.9 | 55.1 | 43.9 |
| 19. scaff_II.202 | 38.9 | 47.1 | 32.2 | 56.2 | 42.7 | 51.3 | 64.2 | 37.6 | 49.5 | 44.1 | 63.2 | 37.9 | 61.1 |
| 20. scaff_I.2410 | 44.8 | 41.2 | 30.3 | 40.0 | 42.7 | 47.9 | 53.3 | 38.5 | 53.2 | 48.0 | 52.2 | 47.1 | 57.0 |
| 21. scaff_I.1483 | 54.9 | 68.1 | 55.3 | 45.1 | 54.7 | 41.0 | 43.4 | 59.8 | 39.8 | 36.3 | 42.5 | 54.0 | 45.1 |
| 22. scaff_I.1926 | 18.4 | 26.1 | 30.6 | 26.1 | 22.4 | 22.4 | 22.0 | 23.3 | 21.2 | 20.0 | 21.6 | 18.0 | 19.2 |
| 23. scaff_XII.704 | 43.6 | 27.7 | 22.4 | 41.9 | 30.8 | 38.5 | 47.8 | 23.9 | 39.4 | 33.3 | 46.7 | 36.9 | 48.4 |
| 24. scaff_41.75 | 49.5 | 41.2 | 30.9 | 48.6 | 44.4 | 50.4 | 73.9 | 40.2 | 51.1 | 45.1 | 72.8 | 44.0 | 62.4 |
| 25. scaff_40.379 | 48.9 | 43.7 | 32.2 | 43.8 | 45.3 | 53.0 | 56.5 | 44.4 | 64.9 | 57.8 | 55.4 | 45.5 | 67.7 |
| 26. scaff_XV.507 | 39.8 | 39.5 | 28.3 | 48.6 | 37.6 | 41.9 | 55.9 | 36.8 | 42.6 | 44.1 | 54.8 | 38.7 | 52.7 |
| 27. scaff_II.203 | 43.6 | 29.4 | 24.3 | 36.2 | 32.5 | 38.5 | 54.3 | 28.2 | 40.4 | 34.3 | 53.3 | 41.7 | 47.3 |
| 28. scaff_II.2328 | 58.9 | 56.3 | 43.4 | 45.7 | 53.8 | 47.0 | 55.8 | 53.0 | 45.3 | 44.1 | 55.8 | 56.8 | 54.7 |
| 29. scaff_XIX.758 | 44.8 | 39.5 | 30.9 | 42.9 | 41.9 | 41.0 | 53.3 | 38.5 | 47.9 | 39.2 | 52.2 | 43.7 | 44.1 |
| 30. TA45751_4081 | 47.4 | 32.8 | 23.7 | 32.4 | 33.3 | 41.0 | 44.6 | 34.2 | 46.8 | 44.1 | 44.6 | 45.2 | 51.6 |
| 31. TA48119_4081 | 25.3 | 37.7 | 39.5 | 41.8 | 39.0 | 39.7 | 37.0 | 37.7 | 33.6 | 32.2 | 36.3 | 24.7 | 37.7 |
| 32. TA35962_4081 | 37.5 | 47.1 | 36.2 | 49.5 | 44.4 | 47.0 | 61.5 | 42.7 | 48.1 | 43.3 | 60.6 | 38.5 | 52.9 |
| 33. BI208422 | 65.4 | 50.4 | 40.8 | 40.0 | 46.2 | 36.8 | 43.5 | 48.7 | 40.4 | 43.1 | 43.5 | 63.1 | 46.2 |
| 34. BG128975 | 51.8 | 64.7 | 50.0 | 50.0 | 58.1 | 44.4 | 44.6 | 62.4 | 40.2 | 35.7 | 43.8 | 50.9 | 43.8 |
| 35. TA52374_4081 | 36.6 | 46.2 | 35.5 | 53.6 | 47.0 | 47.9 | 58.0 | 46.2 | 46.4 | 44.6 | 57.1 | 39.3 | 52.7 |
| 36. TA37180_4081 | 57.3 | 55.5 | 45.4 | 45.7 | 50.4 | 43.6 | 49.0 | 53.0 | 42.7 | 49.0 | 49.0 | 56.3 | 50.0 |
| 37. BE353147 | 39.2 | 44.5 | 37.5 | 59.0 | 36.8 | 49.6 | 59.8 | 40.2 | 47.1 | 41.2 | 58.8 | 37.3 | 52.9 |
| 38. TA56938_4081 | 62.5 | 60.5 | 46.7 | 49.5 | 47.9 | 41.9 | 48.1 | 60.7 | 42.3 | 49.0 | 47.1 | 55.8 | 50.0 |
| 39. BG130916 | 70.5 | 48.7 | 38.2 | 40.0 | 39.3 | 36.8 | 40.2 | 46.2 | 36.2 | 37.3 | 39.1 | 59.5 | 45.2 |
| 40. SEQ ID NO: 276 | 51.8 | 68.1 | 50.7 | 48.2 | 52.1 | 44.4 | 45.6 | 58.1 | 44.7 | 42.1 | 44.7 | 50.0 | 45.6 |
| 41. TA41886_4081 | 37.9 | 45.4 | 34.9 | 59.0 | 35.9 | 52.1 | 58.3 | 38.5 | 45.6 | 39.8 | 58.3 | 37.9 | 56.3 |
| 42. TA36295_4081 | 46.6 | 45.4 | 35.5 | 49.5 | 47.0 | 41.0 | 53.4 | 41.9 | 47.6 | 45.6 | 52.4 | 41.7 | 55.3 |
| 43. TA56201_4081 | 50.0 | 44.5 | 36.2 | 47.6 | 41.9 | 41.0 | 43.6 | 47.0 | 44.7 | 45.1 | 43.6 | 43.6 | 51.1 |
| 44. AJ785329 | 52.6 | 31.9 | 24.3 | 26.7 | 29.1 | 23.9 | 30.4 | 34.2 | 26.6 | 28.4 | 30.4 | 47.6 | 30.1 |
| 45. CA725087 | 49.1 | 54.6 | 41.4 | 37.9 | 49.6 | 36.8 | 41.4 | 56.4 | 35.3 | 42.2 | 41.4 | 55.2 | 39.7 |
| 46. TA69823_4565 | 24.4 | 30.3 | 29.9 | 25.4 | 29.4 | 33.3 | 25.4 | 27.9 | 28.4 | 38.8 | 25.4 | 20.4 | 28.4 |
| 47. TA53297_4565 | 43.5 | 42.9 | 32.9 | 50.5 | 46.2 | 47.0 | 87.0 | 37.6 | 48.9 | 36.3 | 85.9 | 46.7 | 58.1 |
| 48. TA101332_4565 | 50.5 | 55.5 | 40.1 | 47.6 | 63.2 | 47.9 | 55.3 | 56.4 | 45.6 | 47.6 | 54.4 | 48.5 | 50.5 |
| 49. TA66036_4565 | 44.7 | 44.5 | 34.9 | 47.6 | 39.3 | 73.5 | 59.6 | 40.2 | 63.8 | 53.9 | 59.6 | 42.6 | 90.4 |
| 50. TA100367_4565 | 55.3 | 49.6 | 45.4 | 44.7 | 47.9 | 37.6 | 40.4 | 59.0 | 36.8 | 42.1 | 39.5 | 62.3 | 38.6 |
| 51. TA92393_4565 | 60.4 | 55.5 | 42.1 | 43.8 | 51.3 | 41.0 | 48.5 | 58.1 | 42.6 | 48.0 | 48.5 | 73.3 | 44.6 |
| 52. BM136027 | 43.6 | 45.4 | 34.2 | 47.6 | 40.2 | 72.6 | 58.5 | 40.2 | 62.8 | 55.9 | 58.5 | 42.6 | 89.4 |
| 53. CA705831 | 33.6 | 42.0 | 32.2 | 38.1 | 47.9 | 65.0 | 44.2 | 41.0 | 48.7 | 43.4 | 44.2 | 35.4 | 69.0 |
| 54. CA593033 | 29.7 | 38.3 | 31.6 | 35.2 | 41.4 | 60.2 | 40.6 | 36.7 | 44.5 | 40.6 | 40.6 | 28.1 | 61.7 |
| 55. CK153563 | 60.6 | 53.8 | 40.8 | 41.9 | 49.6 | 38.5 | 52.1 | 57.3 | 44.7 | 45.1 | 52.1 | 68.1 | 47.9 |
| 56. TA66038_4565 | 40.8 | 45.4 | 33.6 | 42.9 | 38.5 | 70.9 | 58.2 | 41.0 | 63.3 | 52.0 | 58.2 | 41.8 | 85.7 |
| 57. TA52915_4565 | 43.5 | 41.2 | 32.2 | 51.4 | 45.3 | 46.2 | 85.9 | 38.5 | 47.9 | 36.3 | 84.8 | 46.7 | 58.1 |
| 58. TA69821_4565 | 41.1 | 41.2 | 38.2 | 40.2 | 47.0 | 46.2 | 46.7 | 44.4 | 49.5 | 75.7 | 46.7 | 34.6 | 50.5 |
| 59. TA95153_4565 | 30.8 | 38.7 | 34.9 | 41.0 | 39.3 | 40.2 | 47.0 | 36.8 | 39.3 | 36.8 | 46.2 | 35.9 | 41.9 |
| 60. CD899399 | 39.8 | 44.5 | 32.9 | 42.9 | 38.5 | 73.5 | 57.1 | 40.2 | 62.2 | 52.9 | 57.1 | 39.8 | 88.8 |
| 61. TA77646_4565 | 61.6 | 57.1 | 43.4 | 44.8 | 51.3 | 38.5 | 50.5 | 59.0 | 41.4 | 50.0 | 50.5 | 70.7 | 48.5 |
| 62. TA51752_4565 | 29.5 | 39.5 | 37.5 | 34.9 | 34.9 | 42.6 | 44.2 | 38.8 | 38.8 | 35.7 | 43.4 | 31.0 | 38.0 |
| 63. Pop_GASA | 49.4 | 43.7 | 32.2 | 42.9 | 43.6 | 48.7 | 53.3 | 42.7 | 58.5 | 52.0 | 52.2 | 47.2 | 60.2 |
| 64. Mt_GASA | 36.6 | 43.7 | 36.8 | 50.9 | 47.9 | 45.3 | 50.0 | 42.7 | 50.0 | 44.6 | 49.1 | 36.6 | 48.2 |
| 65. At2g30810 | 57.5 | 61.3 | 45.4 | 50.9 | 55.6 | 45.3 | 43.4 | 60.7 | 39.6 | 45.3 | 42.5 | 51.9 | 46.2 |
| 66. At3g02885 | 62.9 | 58.0 | 46.1 | 46.7 | 54.7 | 44.4 | 54.6 | 57.3 | 47.4 | 48.0 | 53.6 | 59.8 | 50.5 |
| 67. At5g15230 | 57.5 | 53.8 | 40.8 | 43.4 | 52.1 | 42.7 | 44.3 | 55.6 | 42.5 | 43.4 | 43.4 | 54.7 | 43.4 |
| 68. At1g74670 | 62.4 | 60.5 | 45.4 | 45.7 | 49.6 | 40.2 | 52.5 | 57.3 | 41.6 | 49.0 | 51.5 | 58.4 | 44.6 |

| | 14 | 15 | 16 | 17 | 18 | 19 | 20 | 21 | 22 | 23 | 24 | 25 | 26 |
|---|---|---|---|---|---|---|---|---|---|---|---|---|---|
| 1. TA5035_4679 | 31.1 | 29.7 | 38.8 | 51.0 | 56.1 | 31.6 | 34.5 | 48.7 | 12.2 | 36.7 | 37.6 | 37.5 | 32.3 |
| 2. TA5923_4679 | 34.2 | 36.1 | 43.8 | 55.5 | 46.2 | 37.0 | 28.6 | 54.6 | 17.6 | 22.5 | 29.4 | 31.1 | 27.5 |
| 3. Os05g0376800 | 28.3 | 28.3 | 36.8 | 42.8 | 38.2 | 26.3 | 22.4 | 49.3 | 22.0 | 18.3 | 23.0 | 24.3 | 21.6 |
| 4. Os04g0465300 | 34.3 | 39.0 | 32.8 | 32.4 | 33.6 | 42.9 | 28.6 | 31.6 | 21.4 | 36.2 | 34.0 | 32.4 | 39.0 |
| 5. Os10g0115550 | 27.4 | 28.6 | 35.6 | 39.0 | 38.3 | 31.9 | 32.5 | 34.9 | 14.0 | 27.1 | 32.5 | 34.2 | 32.2 |

TABLE C2-continued

MatGAT results for global similarity and identity over the full length of the polypeptide sequences.

| | | | | | | | | | | | | | |
|---|---|---|---|---|---|---|---|---|---|---|---|---|---|
| 6. AK105729 | 39.3 | 36.0 | 31.0 | 32.5 | 32.5 | 41.5 | 40.2 | 30.6 | 16.3 | 30.5 | 41.0 | 47.0 | 33.9 |
| 7. Os05g0432200 | 34.3 | 49.0 | 28.9 | 34.0 | 34.6 | 53.1 | 38.0 | 32.7 | 18.0 | 43.0 | 59.8 | 41.3 | 48.4 |
| 8. Os09g0414900 | 32.5 | 29.9 | 38.8 | 45.3 | 52.1 | 29.1 | 29.1 | 48.7 | 16.3 | 20.3 | 30.8 | 33.3 | 25.4 |
| 9. Os03g0607200 | 37.1 | 35.6 | 25.8 | 27.1 | 28.2 | 37.8 | 38.3 | 29.3 | 14.5 | 31.6 | 35.1 | 47.9 | 33.3 |
| 10. Os07g0592000 | 39.3 | 33.0 | 29.3 | 30.8 | 33.6 | 35.0 | 35.0 | 27.0 | 14.6 | 24.5 | 31.1 | 42.7 | 31.7 |
| 11. AK110640 | 34.3 | 48.0 | 28.9 | 34.0 | 34.6 | 52.1 | 38.0 | 32.7 | 17.6 | 41.9 | 58.7 | 41.3 | 47.3 |
| 12. Os06g0266800 | 32.4 | 29.8 | 38.8 | 51.0 | 49.5 | 32.6 | 35.6 | 50.4 | 13.5 | 32.9 | 37.4 | 39.8 | 34.4 |
| 13. Os03g0760800 | 44.9 | 43.3 | 30.6 | 35.9 | 34.2 | 44.9 | 47.3 | 33.6 | 13.7 | 38.3 | 51.1 | 60.6 | 39.6 |
| 14. scaff_205.30 | | 35.9 | 28.9 | 33.0 | 36.1 | 37.3 | 49.0 | 33.6 | 16.7 | 26.2 | 32.4 | 54.9 | 31.1 |
| 15. scaff_II.204 | 44.1 | | 29.8 | 31.7 | 31.8 | 77.2 | 31.7 | 37.4 | 19.6 | 39.2 | 43.6 | 34.7 | 49.0 |
| 16. scaff_II.2330 | 38.0 | 37.2 | | 39.7 | 40.5 | 28.9 | 24.8 | 41.3 | 17.1 | 23.8 | 30.6 | 30.6 | 25.4 |
| 17. scaff_VI.397 | 46.1 | 47.5 | 47.1 | | 49.5 | 35.0 | 32.0 | 61.4 | 18.4 | 27.7 | 36.3 | 37.0 | 26.7 |
| 18. scf_XVII.377 | 53.3 | 48.6 | 45.5 | 60.7 | | 33.6 | 29.9 | 54.0 | 13.5 | 25.0 | 34.6 | 38.9 | 33.3 |
| 19. scaff_II.202 | 45.1 | 85.1 | 32.2 | 47.0 | 43.0 | | 33.3 | 33.6 | 18.0 | 46.9 | 47.4 | 36.1 | 53.1 |
| 20. scaff_I.2410 | 55.9 | 43.6 | 40.5 | 44.0 | 45.8 | 46.3 | | 31.0 | 14.3 | 30.7 | 36.3 | 62.5 | 35.7 |
| 21. scaff_I.1483 | 46.0 | 48.7 | 52.1 | 64.6 | 62.8 | 44.2 | 45.1 | | 15.5 | 24.6 | 33.6 | 36.3 | 30.7 |
| 22. scaff_I.1926 | 22.4 | 24.9 | 22.4 | 23.3 | 21.2 | 21.2 | 20.4 | 24.5 | | 19.2 | 15.9 | 15.5 | 21.5 |
| 23. scaff_XII.704 | 31.4 | 44.6 | 26.4 | 34.0 | 29.9 | 51.6 | 40.2 | 30.1 | 19.6 | | 41.3 | 32.6 | 63.8 |
| 24. scaff_41.75 | 47.1 | 58.4 | 39.7 | 48.0 | 47.7 | 61.1 | 50.5 | 47.8 | 21.2 | 48.4 | | 41.8 | 45.2 |
| 25. scaff_40.379 | 58.8 | 44.6 | 39.7 | 47.0 | 50.5 | 47.4 | 72.7 | 45.1 | 19.6 | 39.8 | 50.5 | | 36.2 |
| 26. scaff_XV.507 | 37.3 | 61.4 | 38.8 | 40.0 | 43.0 | 67.4 | 49.5 | 40.7 | 23.7 | 67.7 | 57.0 | 46.2 | |
| 27. scaff_II.203 | 33.3 | 55.4 | 30.6 | 37.0 | 30.8 | 56.8 | 39.1 | 34.5 | 18.0 | 67.6 | 57.1 | 40.9 | 52.7 |
| 28. scaff_II.2328 | 49.0 | 49.5 | 60.3 | 62.0 | 57.9 | 46.3 | 50.5 | 61.9 | 22.0 | 34.7 | 53.7 | 53.7 | 47.4 |
| 29. scaff_XIX.758 | 37.3 | 51.5 | 40.5 | 46.0 | 43.9 | 56.8 | 43.7 | 40.7 | 23.7 | 52.9 | 58.2 | 50.0 | 55.9 |
| 30. TA45751_4081 | 51.0 | 32.7 | 30.6 | 40.0 | 37.4 | 35.8 | 63.2 | 31.9 | 14.7 | 51.5 | 42.9 | 67.0 | 36.6 |
| 31. TA48119_4081 | 35.6 | 45.9 | 37.0 | 32.2 | 31.5 | 44.5 | 33.6 | 37.0 | 32.2 | 41.8 | 37.7 | 31.5 | 52.7 |
| 32. TA35962_4081 | 40.4 | 75.0 | 37.2 | 46.2 | 44.9 | 75.0 | 41.3 | 50.4 | 24.9 | 47.1 | 61.5 | 43.3 | 58.7 |
| 33. BI208422 | 45.1 | 42.6 | 50.4 | 58.0 | 54.2 | 43.2 | 46.0 | 56.6 | 18.8 | 37.0 | 48.4 | 51.1 | 44.1 |
| 34. BG128975 | 45.5 | 49.1 | 52.9 | 69.6 | 59.8 | 42.9 | 42.9 | 78.8 | 24.9 | 29.5 | 49.1 | 48.2 | 39.3 |
| 35. TA52374_4081 | 49.1 | 62.5 | 38.0 | 44.6 | 52.7 | 59.8 | 39.3 | 52.2 | 25.7 | 42.0 | 54.5 | 42.9 | 52.7 |
| 36. TA37180_4081 | 48.0 | 46.5 | 55.4 | 63.0 | 61.7 | 49.0 | 47.9 | 62.8 | 22.4 | 31.3 | 49.0 | 50.0 | 46.9 |
| 37. BE353147 | 48.0 | 61.8 | 34.7 | 48.0 | 43.0 | 63.7 | 41.2 | 47.8 | 24.1 | 45.1 | 56.9 | 46.1 | 55.9 |
| 38. TA56938_4081 | 54.8 | 52.9 | 51.2 | 62.5 | 84.1 | 47.1 | 47.1 | 66.4 | 24.9 | 32.7 | 48.1 | 50.0 | 43.3 |
| 39. BG130916 | 38.2 | 38.6 | 46.3 | 60.0 | 47.7 | 38.9 | 47.1 | 54.0 | 18.4 | 44.4 | 45.1 | 44.3 | 38.7 |
| 40. SEQ ID NO: 276 | 47.4 | 45.6 | 52.1 | 71.1 | 60.5 | 43.9 | 43.9 | 71.9 | 26.9 | 27.2 | 42.1 | 44.7 | 38.6 |
| 41. TA41886_4081 | 51.5 | 61.2 | 38.8 | 44.7 | 41.1 | 64.1 | 39.8 | 46.9 | 26.1 | 45.6 | 58.3 | 43.7 | 59.2 |
| 42. TA36295_4081 | 42.7 | 58.3 | 39.7 | 44.7 | 48.6 | 54.4 | 45.6 | 48.7 | 24.5 | 42.7 | 57.3 | 49.5 | 55.3 |
| 43. TA56201_4081 | 50.0 | 45.5 | 38.8 | 48.0 | 51.4 | 43.2 | 53.2 | 49.6 | 18.8 | 29.8 | 46.8 | 51.1 | 38.3 |
| 44. AJ785329 | 29.4 | 26.7 | 29.8 | 36.0 | 35.5 | 29.5 | 35.6 | 34.5 | 12.2 | 43.9 | 31.9 | 35.2 | 33.3 |
| 45. CA725087 | 42.2 | 39.7 | 49.6 | 47.4 | 57.8 | 38.8 | 38.8 | 60.3 | 19.2 | 23.3 | 42.2 | 38.8 | 35.3 |
| 46. TA69823_4565 | 27.9 | 26.9 | 27.4 | 25.9 | 26.9 | 23.4 | 25.9 | 28.9 | 26.5 | 15.9 | 24.4 | 28.9 | 24.4 |
| 47. TA53297_4565 | 41.2 | 60.4 | 41.3 | 42.0 | 47.7 | 66.3 | 47.8 | 47.8 | 22.0 | 47.8 | 72.8 | 48.9 | 58.1 |
| 48. TA101332_4565 | 46.6 | 49.5 | 45.5 | 57.3 | 57.0 | 55.3 | 46.6 | 56.6 | 24.5 | 35.0 | 52.4 | 52.4 | 47.6 |
| 49. TA66036_4565 | 55.9 | 52.5 | 39.7 | 49.0 | 43.9 | 56.8 | 59.6 | 46.0 | 20.4 | 45.7 | 58.5 | 61.7 | 51.1 |
| 50. TA100367_4565 | 43.9 | 47.4 | 47.1 | 55.3 | 60.5 | 43.9 | 40.4 | 62.3 | 22.4 | 26.3 | 43.0 | 42.1 | 36.0 |
| 51. TA92393_4565 | 47.1 | 48.5 | 51.2 | 59.4 | 67.3 | 46.5 | 47.5 | 64.6 | 19.6 | 29.7 | 50.5 | 45.5 | 40.6 |
| 52. BM136027 | 54.9 | 55.4 | 38.8 | 49.0 | 44.9 | 57.9 | 59.6 | 46.0 | 20.4 | 45.7 | 57.4 | 60.6 | 51.1 |
| 53. CA705831 | 50.4 | 46.0 | 38.8 | 38.9 | 41.6 | 43.4 | 45.1 | 44.2 | 18.0 | 31.0 | 44.2 | 50.4 | 38.9 |
| 54. CA593033 | 45.3 | 39.8 | 33.6 | 32.8 | 33.6 | 38.3 | 40.6 | 37.5 | 17.1 | 29.7 | 39.8 | 45.3 | 36.7 |
| 55. CK153563 | 51.0 | 47.5 | 52.1 | 57.0 | 58.9 | 48.4 | 53.2 | 60.2 | 19.2 | 31.9 | 53.2 | 51.1 | 42.6 |
| 56. TA66038_4565 | 56.9 | 49.5 | 38.8 | 45.0 | 45.8 | 52.0 | 57.1 | 46.9 | 18.8 | 41.8 | 56.1 | 64.3 | 50.0 |
| 57. TA52915_4565 | 40.2 | 61.4 | 42.1 | 43.0 | 48.6 | 64.2 | 52.2 | 46.9 | 22.0 | 47.8 | 72.8 | 47.8 | 59.1 |
| 58. TA69821_4565 | 53.3 | 43.0 | 38.0 | 42.1 | 45.8 | 43.0 | 46.7 | 43.4 | 22.4 | 29.0 | 46.7 | 53.3 | 39.3 |
| 59. TA95153_4565 | 37.6 | 41.9 | 33.1 | 37.6 | 37.6 | 45.3 | 39.3 | 41.0 | 22.0 | 31.6 | 43.6 | 38.5 | 43.6 |
| 60. CD899399 | 56.9 | 49.5 | 38.8 | 45.0 | 44.9 | 52.0 | 57.1 | 46.9 | 20.0 | 41.8 | 58.2 | 63.3 | 52.0 |
| 61. TA77646_4565 | 50.0 | 49.5 | 52.1 | 58.0 | 66.4 | 48.5 | 48.5 | 64.6 | 20.0 | 30.3 | 53.5 | 48.5 | 44.4 |
| 62. TA51752_4565 | 38.0 | 39.5 | 31.0 | 35.7 | 38.8 | 44.2 | 38.0 | 39.5 | 23.3 | 30.2 | 40.3 | 34.9 | 41.9 |
| 63. Pop_GASA | 58.8 | 43.6 | 41.3 | 48.0 | 46.7 | 46.3 | 78.7 | 47.8 | 21.2 | 38.2 | 49.5 | 78.7 | 43.0 |
| 64. Mt_GASA | 42.0 | 58.0 | 44.6 | 43.8 | 48.2 | 51.8 | 44.6 | 49.6 | 26.9 | 48.2 | 48.2 | 50.0 | 67.0 |
| 65. At2g30810 | 48.1 | 50.9 | 51.2 | 59.4 | 61.7 | 48.1 | 44.3 | 61.1 | 26.1 | 31.1 | 48.1 | 43.4 | 41.5 |
| 66. At3g02885 | 48.0 | 45.5 | 56.2 | 62.0 | 66.4 | 45.4 | 51.5 | 61.9 | 21.6 | 35.1 | 52.6 | 56.7 | 50.5 |
| 67. At5g15230 | 46.2 | 43.4 | 46.3 | 53.8 | 80.4 | 39.6 | 45.3 | 61.1 | 23.3 | 31.1 | 42.5 | 47.2 | 42.5 |
| 68. At1g74670 | 50.0 | 52.5 | 48.8 | 65.3 | 74.8 | 50.5 | 44.6 | 63.7 | 23.3 | 35.6 | 46.5 | 48.5 | 47.5 |

| | 27 | 28 | 29 | 30 | 31 | 32 | 33 | 34 | 35 | 36 | 37 | 38 | 39 |
|---|---|---|---|---|---|---|---|---|---|---|---|---|---|
| 1. TA5035_4679 | 35.9 | 48.4 | 34.5 | 41.0 | 21.2 | 30.8 | 56.8 | 44.6 | 29.5 | 49.0 | 32.4 | 58.7 | 56.4 |
| 2. TA5923_4679 | 23.5 | 47.9 | 31.9 | 26.9 | 28.1 | 35.5 | 43.7 | 54.6 | 31.9 | 46.3 | 32.8 | 47.9 | 42.0 |
| 3. Os05g0376800 | 19.1 | 34.9 | 22.4 | 21.1 | 24.1 | 25.7 | 33.6 | 42.1 | 27.0 | 36.8 | 27.6 | 39.5 | 34.9 |
| 4. Os04g0465300 | 33.3 | 38.1 | 32.4 | 25.7 | 33.1 | 41.0 | 32.4 | 36.0 | 39.8 | 36.8 | 45.5 | 35.8 | 29.5 |
| 5. Os10g0115550 | 24.8 | 42.1 | 29.1 | 29.1 | 27.7 | 31.1 | 40.2 | 39.1 | 31.0 | 39.3 | 28.2 | 35.0 | 32.5 |
| 6. AK105729 | 32.5 | 33.3 | 29.1 | 38.5 | 28.2 | 37.6 | 28.2 | 30.8 | 36.8 | 30.5 | 35.9 | 35.0 | 29.1 |
| 7. Os05g0432200 | 45.7 | 42.1 | 41.3 | 34.8 | 30.8 | 47.6 | 33.7 | 35.7 | 46.4 | 40.6 | 44.7 | 38.5 | 33.7 |
| 8. Os09g0414900 | 22.2 | 43.6 | 28.2 | 29.1 | 28.4 | 32.5 | 41.0 | 48.3 | 33.3 | 43.6 | 29.1 | 51.3 | 40.2 |
| 9. Os03g0607200 | 33.0 | 31.6 | 33.7 | 36.2 | 24.8 | 37.4 | 30.9 | 27.0 | 32.2 | 27.3 | 34.3 | 29.0 | 26.6 |
| 10. Os07g0592000 | 27.2 | 35.0 | 28.8 | 34.0 | 21.6 | 30.2 | 29.1 | 28.9 | 31.6 | 31.7 | 28.8 | 33.6 | 27.5 |
| 11. AK110640 | 44.6 | 42.1 | 40.2 | 34.8 | 30.1 | 46.7 | 33.7 | 35.7 | 45.5 | 40.6 | 43.7 | 38.5 | 33.7 |
| 12. Os06g0266800 | 34.5 | 53.7 | 37.9 | 39.3 | 21.9 | 28.8 | 56.0 | 46.4 | 33.9 | 50.0 | 28.4 | 51.0 | 56.5 |

TABLE C2-continued

MatGAT results for global similarity and identity over the full length of the polypeptide sequences.

| | | | | | | | | | | | | | |
|---|---|---|---|---|---|---|---|---|---|---|---|---|---|
| 13. Os03g0760800 | 38.7 | 40.8 | 33.3 | 48.4 | 28.2 | 40.2 | 35.5 | 33.0 | 40.0 | 36.4 | 35.2 | 35.5 | 37.6 |
| 14. scaff_205.30 | 30.4 | 37.3 | 29.4 | 47.1 | 27.4 | 33.7 | 32.4 | 33.9 | 38.3 | 34.0 | 34.9 | 39.0 | 31.4 |
| 15. scaff_II.204 | 48.5 | 42.6 | 40.6 | 29.7 | 34.2 | 64.4 | 32.7 | 36.6 | 50.9 | 36.6 | 52.9 | 38.1 | 29.7 |
| 16. scaff_II.2330 | 25.6 | 53.7 | 28.9 | 24.8 | 25.9 | 31.4 | 43.9 | 43.0 | 32.2 | 45.5 | 27.3 | 40.5 | 40.5 |
| 17. scaff_VI.397 | 27.0 | 55.0 | 33.0 | 32.0 | 22.6 | 30.8 | 53.0 | 59.8 | 33.0 | 57.0 | 34.0 | 54.8 | 54.0 |
| 18. scf_XVII.377 | 25.2 | 47.7 | 33.6 | 29.9 | 24.7 | 31.8 | 45.8 | 51.8 | 36.8 | 52.3 | 31.8 | 77.6 | 47.7 |
| 19. scaff_II.202 | 50.5 | 37.9 | 41.1 | 32.6 | 36.3 | 62.5 | 34.7 | 36.6 | 50.0 | 36.5 | 51.0 | 39.4 | 31.6 |
| 20. scaff_I.2410 | 32.2 | 38.9 | 35.6 | 58.6 | 24.5 | 33.3 | 34.5 | 31.3 | 28.6 | 36.5 | 29.4 | 31.7 | 33.3 |
| 21. scaff_I.1483 | 25.7 | 51.3 | 29.2 | 27.4 | 25.3 | 36.3 | 48.7 | 65.2 | 37.0 | 52.6 | 33.9 | 54.9 | 47.8 |
| 22. scaff_I.1926 | 16.3 | 16.3 | 18.0 | 12.2 | 27.3 | 19.5 | 14.3 | 17.6 | 20.4 | 14.9 | 19.9 | 15.9 | 13.9 |
| 23. scaff_XII.704 | 60.9 | 30.2 | 45.5 | 43.9 | 39.7 | 43.8 | 32.9 | 24.8 | 35.4 | 27.8 | 40.8 | 27.6 | 35.6 |
| 24. scaff_41.75 | 44.0 | 43.2 | 42.9 | 35.2 | 29.5 | 47.1 | 37.4 | 34.5 | 45.5 | 36.5 | 42.2 | 35.6 | 38.5 |
| 25. scaff_40.379 | 34.1 | 38.9 | 34.1 | 63.6 | 24.7 | 31.7 | 40.9 | 35.7 | 34.2 | 39.6 | 32.4 | 39.0 | 37.5 |
| 26. scaff_XV.507 | 47.3 | 36.1 | 45.2 | 32.3 | 47.3 | 48.6 | 36.6 | 31.9 | 43.4 | 36.4 | 43.7 | 32.4 | 30.1 |
| 27. scaff_II.203 | | 36.8 | 48.3 | 41.2 | 28.8 | 49.0 | 38.3 | 26.8 | 38.4 | 32.3 | 43.1 | 27.9 | 38.9 |
| 28. scaff_II.2328 | 42.1 | | 36.5 | 32.6 | 26.7 | 37.5 | 66.3 | 50.9 | 37.7 | 69.1 | 35.9 | 55.8 | 49.5 |
| 29. scaff_XIX.758 | 55.2 | 45.3 | | 31.0 | 29.5 | 48.1 | 41.4 | 31.3 | 34.8 | 37.8 | 38.2 | 36.5 | 34.5 |
| 30. TA45751_4081 | 47.1 | 40.0 | 40.2 | | 20.5 | 27.9 | 37.0 | 29.5 | 31.3 | 32.3 | 27.5 | 30.8 | 40.3 |
| 31. TA48119_4081 | 31.5 | 33.6 | 40.4 | 26.7 | | 33.6 | 22.6 | 27.4 | 37.7 | 25.0 | 36.7 | 26.0 | 20.5 |
| 32. TA35962_4081 | 55.8 | 47.1 | 54.8 | 29.8 | 45.9 | | 29.8 | 33.3 | 50.0 | 36.5 | 50.0 | 32.7 | 26.9 |
| 33. BI208422 | 46.9 | 75.8 | 52.9 | 43.2 | 28.1 | 41.3 | | 52.7 | 33.9 | 84.4 | 35.3 | 49.0 | 61.7 |
| 34. BG128975 | 33.9 | 65.2 | 41.1 | 34.8 | 39.7 | 47.3 | 59.8 | | 33.6 | 53.1 | 35.7 | 58.0 | 48.2 |
| 35. TA52374_4081 | 50.0 | 48.2 | 46.4 | 34.8 | 47.3 | 64.3 | 40.2 | 44.6 | | 33.9 | 40.2 | 39.8 | 28.3 |
| 36. TA37180_4081 | 39.6 | 82.3 | 50.0 | 38.5 | 32.9 | 47.1 | 84.4 | 65.2 | 44.6 | | 39.0 | 53.8 | 51.0 |
| 37. BE353147 | 48.0 | 53.9 | 52.0 | 33.3 | 43.8 | 62.5 | 45.1 | 48.2 | 54.5 | 50.0 | | 37.7 | 29.4 |
| 38. TA56938_4081 | 34.6 | 65.4 | 48.1 | 37.5 | 31.5 | 41.3 | 56.7 | 65.2 | 51.8 | 61.5 | 49.0 | | 50.0 |
| 39. BG130916 | 51.4 | 55.8 | 47.1 | 50.0 | 24.7 | 35.6 | 64.2 | 54.5 | 34.8 | 54.2 | 39.2 | 51.9 | |
| 40. SEQ ID NO: 276 | 30.7 | 57.9 | 38.6 | 34.2 | 34.9 | 43.0 | 53.5 | 70.2 | 43.0 | 59.6 | 43.9 | 65.8 | 53.5 |
| 41. TA41886_4081 | 49.5 | 50.5 | 48.5 | 34.0 | 43.2 | 63.5 | 42.7 | 40.2 | 54.5 | 50.5 | 82.5 | 42.3 | 38.8 |
| 42. TA36295_4081 | 46.6 | 49.5 | 68.0 | 35.0 | 41.1 | 65.4 | 48.5 | 53.6 | 55.4 | 48.5 | 57.3 | 55.8 | 43.7 |
| 43. TA56201_4081 | 31.9 | 55.8 | 38.3 | 41.5 | 28.1 | 38.5 | 52.1 | 44.6 | 42.9 | 54.2 | 45.1 | 51.9 | 47.9 |
| 44. AJ785329 | 38.2 | 41.1 | 34.5 | 44.6 | 19.2 | 27.9 | 45.7 | 33.9 | 26.8 | 37.5 | 23.5 | 36.5 | 51.4 |
| 45. CA725087 | 30.2 | 54.3 | 33.6 | 29.3 | 28.8 | 41.4 | 50.0 | 55.2 | 44.0 | 54.3 | 38.8 | 56.0 | 41.4 |
| 46. TA69823_4565 | 17.4 | 27.9 | 22.9 | 22.4 | 34.3 | 23.9 | 20.9 | 27.9 | 25.9 | 24.9 | 23.9 | 26.9 | 21.4 |
| 47. TA53297_4565 | 52.2 | 52.6 | 57.6 | 39.1 | 38.4 | 60.6 | 43.5 | 45.5 | 55.4 | 51.0 | 62.7 | 46.2 | 40.2 |
| 48. TA101332_4565 | 36.9 | 61.2 | 46.6 | 39.8 | 36.3 | 51.9 | 54.4 | 56.3 | 49.1 | 60.2 | 53.4 | 56.7 | 48.5 |
| 49. TA66036_4565 | 46.8 | 52.6 | 42.6 | 52.1 | 37.0 | 50.0 | 44.7 | 46.4 | 50.0 | 51.0 | 53.9 | 50.0 | 41.5 |
| 50. TA100367_4565 | 32.5 | 53.5 | 36.8 | 34.2 | 32.9 | 36.8 | 48.2 | 57.9 | 43.0 | 51.8 | 43.0 | 55.3 | 46.5 |
| 51. TA92393_4565 | 36.6 | 63.4 | 40.6 | 36.6 | 29.5 | 46.2 | 58.4 | 58.0 | 48.2 | 62.4 | 45.1 | 69.2 | 51.5 |
| 52. BM136027 | 44.7 | 52.6 | 42.6 | 51.1 | 37.0 | 51.0 | 44.7 | 46.4 | 49.1 | 50.0 | 52.0 | 52.9 | 41.5 |
| 53. CA705831 | 33.6 | 45.1 | 32.7 | 42.5 | 30.1 | 41.6 | 38.1 | 46.0 | 46.0 | 41.6 | 42.5 | 49.6 | 36.3 |
| 54. CA593033 | 29.7 | 36.7 | 28.1 | 38.3 | 32.2 | 39.1 | 28.9 | 39.1 | 41.4 | 32.0 | 38.3 | 40.6 | 30.5 |
| 55. CK153563 | 40.4 | 67.4 | 47.9 | 39.4 | 28.8 | 44.2 | 62.8 | 58.0 | 45.5 | 66.7 | 44.1 | 64.4 | 53.2 |
| 56. TA66038_4565 | 41.8 | 49.0 | 42.9 | 51.0 | 37.0 | 51.0 | 42.9 | 41.1 | 50.0 | 45.9 | 47.1 | 49.0 | 43.9 |
| 57. TA52915_4565 | 52.2 | 52.6 | 54.3 | 39.1 | 39.0 | 61.5 | 43.5 | 46.4 | 56.3 | 50.0 | 61.8 | 47.1 | 40.2 |
| 58. TA69821_4565 | 30.8 | 45.8 | 36.4 | 41.1 | 34.9 | 40.2 | 40.2 | 43.8 | 45.5 | 45.8 | 44.9 | 50.5 | 34.6 |
| 59. TA95153_4565 | 31.6 | 37.6 | 38.5 | 28.2 | 36.3 | 47.9 | 34.2 | 40.2 | 47.9 | 36.8 | 44.4 | 39.3 | 31.6 |
| 60. CD899399 | 42.9 | 49.0 | 43.9 | 51.0 | 37.0 | 51.9 | 42.9 | 41.1 | 50.9 | 46.9 | 47.1 | 49.0 | 42.9 |
| 61. TA77646_4565 | 38.4 | 66.7 | 42.4 | 37.4 | 30.1 | 48.1 | 61.6 | 59.8 | 49.1 | 66.7 | 47.1 | 67.3 | 51.5 |
| 62. TA51752_4565 | 29.5 | 34.9 | 35.7 | 27.1 | 38.4 | 45.7 | 30.2 | 36.4 | 51.2 | 34.1 | 41.1 | 39.5 | 28.7 |
| 63. Pop_GASA | 37.1 | 52.6 | 50.6 | 61.8 | 32.2 | 41.3 | 51.7 | 42.9 | 42.9 | 50.0 | 47.1 | 49.0 | 48.3 |
| 64. Mt_GASA | 41.1 | 45.5 | 51.8 | 34.8 | 56.2 | 51.8 | 42.0 | 50.9 | 57.1 | 44.6 | 48.2 | 49.1 | 36.6 |
| 65. At2g30810 | 38.7 | 60.4 | 43.4 | 35.8 | 37.7 | 48.1 | 56.6 | 65.2 | 51.8 | 59.4 | 54.7 | 66.0 | 53.8 |
| 66. At3g02885 | 38.1 | 79.4 | 46.4 | 43.3 | 36.3 | 46.2 | 69.1 | 66.1 | 44.6 | 75.3 | 46.1 | 66.3 | 55.7 |
| 67. At5g15230 | 34.0 | 59.4 | 43.4 | 34.9 | 33.6 | 46.2 | 49.1 | 57.1 | 46.4 | 55.7 | 42.5 | 76.4 | 46.2 |
| 68. At1g74670 | 36.6 | 65.3 | 48.5 | 37.6 | 32.9 | 47.1 | 59.4 | 64.3 | 51.8 | 65.3 | 44.1 | 77.9 | 52.5 |

| | 40 | 41 | 42 | 43 | 44 | 45 | 46 | 47 | 48 | 49 | 50 | 51 | 52 |
|---|---|---|---|---|---|---|---|---|---|---|---|---|---|
| 1. TA5035_4679 | 46.5 | 31.1 | 36.9 | 40.4 | 44.3 | 41.4 | 18.8 | 34.8 | 42.7 | 36.2 | 45.6 | 50.5 | 38.3 |
| 2. TA5923_4679 | 57.9 | 37.0 | 36.1 | 33.3 | 25.8 | 37.5 | 23.3 | 31.7 | 43.3 | 32.8 | 42.9 | 45.4 | 33.6 |
| 3. Os05g0376800 | 44.7 | 25.0 | 26.3 | 27.5 | 19.6 | 27.2 | 22.7 | 27.0 | 30.9 | 27.7 | 33.6 | 32.9 | 27.7 |
| 4. Os04g0465300 | 37.4 | 41.8 | 39.3 | 35.2 | 22.9 | 27.0 | 17.2 | 38.1 | 35.5 | 34.5 | 29.3 | 33.3 | 34.5 |
| 5. Os10g0115550 | 35.4 | 26.9 | 35.5 | 30.5 | 25.4 | 42.1 | 20.0 | 32.5 | 56.4 | 29.9 | 36.2 | 45.3 | 29.9 |
| 6. AK105729 | 33.9 | 36.8 | 32.5 | 35.6 | 22.0 | 24.8 | 27.5 | 37.6 | 35.6 | 69.2 | 33.1 | 30.6 | 68.4 |
| 7. Os05g0432200 | 36.8 | 48.5 | 43.7 | 34.0 | 28.0 | 28.4 | 17.8 | 70.7 | 39.8 | 42.1 | 31.6 | 37.6 | 41.1 |
| 8. Os09g0414900 | 47.9 | 28.1 | 31.6 | 38.1 | 30.5 | 41.0 | 21.3 | 28.2 | 43.6 | 30.8 | 47.0 | 50.4 | 31.7 |
| 9. Os03g0607200 | 29.9 | 31.1 | 34.9 | 35.1 | 23.2 | 27.1 | 21.4 | 35.8 | 32.1 | 51.6 | 28.2 | 31.5 | 50.5 |
| 10. Os07g0592000 | 31.0 | 31.8 | 30.5 | 36.5 | 21.4 | 28.1 | 36.6 | 31.1 | 36.2 | 41.9 | 33.6 | 33.6 | 41.9 |
| 11. AK110640 | 36.8 | 48.5 | 42.7 | 34.0 | 28.0 | 28.4 | 17.8 | 69.6 | 38.8 | 42.1 | 31.6 | 37.6 | 41.1 |
| 12. Os06g0266800 | 45.6 | 32.0 | 35.0 | 38.3 | 41.2 | 50.9 | 17.3 | 37.6 | 41.9 | 38.3 | 59.6 | 70.3 | 37.1 |
| 13. Os03g0760800 | 34.2 | 38.7 | 37.7 | 40.8 | 27.7 | 30.0 | 24.0 | 44.2 | 40.6 | 85.1 | 32.5 | 36.5 | 84.0 |
| 14. scaff_205.30 | 35.1 | 40.2 | 32.0 | 35.9 | 22.3 | 32.5 | 21.8 | 31.4 | 35.0 | 46.3 | 36.0 | 38.8 | 45.4 |
| 15. scaff_II.204 | 36.0 | 53.4 | 47.1 | 32.4 | 22.5 | 28.3 | 18.3 | 51.5 | 35.9 | 41.3 | 32.5 | 37.1 | 44.2 |
| 16. scaff_II.2330 | 42.1 | 31.4 | 33.1 | 30.3 | 27.0 | 32.6 | 19.8 | 29.8 | 37.2 | 31.5 | 38.2 | 42.1 | 31.5 |
| 17. scaff_VI.397 | 61.2 | 32.7 | 35.9 | 38.6 | 32.7 | 36.8 | 21.3 | 31.0 | 43.7 | 37.9 | 45.6 | 47.5 | 37.9 |
| 18. scf_XVII.377 | 51.8 | 32.7 | 38.3 | 37.3 | 31.5 | 41.1 | 20.8 | 35.5 | 42.6 | 31.8 | 49.1 | 53.3 | 32.7 |
| 19. scaff_II.202 | 36.0 | 56.3 | 44.7 | 33.3 | 27.1 | 29.3 | 17.3 | 55.7 | 40.0 | 44.9 | 32.5 | 39.6 | 45.9 |

TABLE C2-continued

MatGAT results for global similarity and identity over the full length of the polypeptide sequences.

| | | | | | | | | | | | | | |
|---|---|---|---|---|---|---|---|---|---|---|---|---|---|
| 20. scaff_I.2410 | 29.8 | 29.1 | 34.0 | 38.3 | 28.4 | 28.4 | 19.3 | 34.8 | 34.0 | 48.9 | 28.1 | 35.6 | 48.9 |
| 21. scaff_I.1483 | 60.5 | 35.1 | 33.6 | 37.7 | 29.8 | 43.1 | 21.3 | 34.5 | 42.5 | 37.9 | 46.5 | 53.1 | 37.9 |
| 22. scaff_I.1926 | 18.8 | 21.1 | 18.8 | 14.7 | 9.4 | 14.5 | 17.8 | 18.8 | 19.2 | 16.1 | 16.3 | 16.3 | 16.1 |
| 23. scaff_XII.704 | 21.7 | 39.4 | 37.5 | 25.5 | 34.8 | 19.8 | 12.8 | 44.1 | 29.8 | 36.8 | 21.7 | 26.5 | 36.8 |
| 24. scaff_41.75 | 32.5 | 45.6 | 43.3 | 38.5 | 29.3 | 31.4 | 18.8 | 56.5 | 40.8 | 47.9 | 34.2 | 40.8 | 46.8 |
| 25. scaff_40.379 | 32.5 | 33.0 | 37.9 | 41.5 | 31.5 | 31.0 | 21.3 | 40.2 | 42.7 | 56.4 | 34.2 | 39.6 | 55.3 |
| 26. scaff_XV.507 | 27.0 | 44.2 | 46.2 | 29.8 | 23.7 | 27.6 | 17.7 | 48.4 | 35.6 | 37.8 | 27.8 | 32.4 | 37.8 |
| 27. scaff_II.203 | 25.4 | 42.7 | 40.8 | 28.7 | 33.3 | 21.6 | 14.4 | 50.0 | 31.1 | 38.3 | 24.6 | 29.7 | 37.2 |
| 28. scaff_II.2328 | 47.4 | 41.7 | 39.4 | 41.4 | 35.4 | 43.3 | 20.8 | 38.9 | 48.5 | 40.8 | 43.5 | 52.9 | 40.8 |
| 29. scaff_XIX.758 | 27.2 | 39.8 | 58.3 | 32.6 | 29.5 | 26.7 | 13.4 | 42.4 | 38.5 | 34.0 | 26.3 | 32.7 | 34.0 |
| 30. TA45751_4081 | 27.2 | 29.1 | 30.1 | 35.1 | 39.4 | 26.7 | 18.3 | 32.6 | 35.0 | 50.0 | 28.9 | 34.7 | 48.9 |
| 31. TA48119_4081 | 23.3 | 36.1 | 32.2 | 21.2 | 15.1 | 21.0 | 22.7 | 31.5 | 30.6 | 28.9 | 24.0 | 24.7 | 28.9 |
| 32. TA35962_4081 | 31.6 | 50.0 | 50.5 | 28.6 | 24.8 | 28.9 | 16.7 | 48.1 | 38.1 | 38.3 | 29.8 | 35.2 | 39.3 |
| 33. BI208422 | 48.2 | 34.0 | 40.8 | 42.6 | 40.2 | 38.8 | 14.9 | 33.7 | 47.6 | 35.8 | 39.5 | 47.5 | 35.8 |
| 34. BG128975 | 63.2 | 30.4 | 40.0 | 33.6 | 28.3 | 39.5 | 21.3 | 35.7 | 42.9 | 34.5 | 46.5 | 49.1 | 35.3 |
| 35. TA52374_4081 | 30.7 | 38.4 | 42.1 | 33.6 | 23.9 | 34.1 | 17.3 | 43.8 | 38.4 | 39.1 | 33.6 | 42.9 | 38.3 |
| 36. TA37180_4081 | 50.0 | 38.1 | 40.8 | 39.4 | 34.0 | 38.8 | 16.3 | 37.5 | 48.5 | 37.4 | 39.7 | 47.5 | 36.4 |
| 37. BE353147 | 33.9 | 72.8 | 44.3 | 33.7 | 21.4 | 26.7 | 18.3 | 47.6 | 40.0 | 37.1 | 33.0 | 32.4 | 36.2 |
| 38. TA56938_4081 | 58.8 | 37.1 | 44.3 | 35.5 | 31.4 | 43.8 | 22.3 | 35.6 | 41.3 | 34.6 | 49.1 | 59.0 | 38.0 |
| 39. BG130916 | 47.4 | 31.1 | 34.0 | 36.2 | 43.8 | 33.3 | 16.4 | 33.7 | 38.8 | 35.1 | 38.6 | 46.1 | 35.1 |
| 40. SEQ ID NO: 276 | | 35.3 | 36.8 | 38.8 | 27.8 | 38.2 | 22.3 | 34.2 | 41.7 | 32.5 | 44.7 | 47.4 | 32.5 |
| 41. TA41886_4081 | 43.9 | | 42.9 | 34.3 | 24.0 | 31.7 | 18.3 | 47.6 | 38.5 | 37.7 | 33.9 | 40.4 | 37.7 |
| 42. TA36295_4081 | 48.2 | 55.3 | | 33.7 | 26.0 | 31.7 | 16.3 | 43.0 | 40.0 | 37.4 | 36.0 | 37.9 | 36.4 |
| 43. TA56201_4081 | 48.2 | 42.7 | 49.5 | | 45.7 | 33.3 | 22.1 | 34.0 | 45.7 | 38.4 | 34.2 | 37.3 | 38.8 |
| 44. AJ785329 | 35.1 | 25.2 | 29.1 | 50.0 | | 27.4 | 12.4 | 24.7 | 33.7 | 26.3 | 28.7 | 35.3 | 26.3 |
| 45. CA725087 | 53.4 | 43.1 | 42.2 | 44.0 | 31.0 | | 16.1 | 29.7 | 39.2 | 28.0 | 54.2 | 73.7 | 28.8 |
| 46. TA69823_4565 | 30.3 | 24.9 | 25.4 | 26.4 | 15.9 | 22.4 | | 18.8 | 21.8 | 21.6 | 19.3 | 17.8 | 21.1 |
| 47. TA53297_4565 | 43.9 | 61.2 | 56.3 | 44.7 | 27.2 | 39.7 | 21.4 | | 40.8 | 44.2 | 29.8 | 39.8 | 43.2 |
| 48. TA101332_4565 | 56.1 | 48.5 | 49.5 | 55.3 | 37.9 | 48.3 | 28.4 | 54.4 | | 39.6 | 38.6 | 48.5 | 39.6 |
| 49. TA66036_4565 | 43.9 | 52.4 | 52.4 | 48.9 | 28.7 | 33.6 | 26.4 | 57.4 | 47.6 | | 34.2 | 34.6 | 98.9 |
| 50. TA100367_4565 | 57.9 | 45.6 | 45.6 | 46.5 | 35.1 | 67.2 | 25.4 | 41.2 | 49.1 | 43.0 | | 68.4 | 35.0 |
| 51. TA92393_4565 | 60.5 | 49.5 | 48.5 | 49.5 | 39.6 | 76.7 | 23.4 | 49.5 | 58.3 | 39.6 | 74.6 | | 35.6 |
| 52. BM136027 | 43.9 | 51.5 | 51.5 | 53.2 | 28.7 | 34.5 | 25.9 | 56.4 | 47.6 | 98.9 | 42.1 | 40.6 | |
| 53. CA705831 | 43.0 | 44.2 | 41.6 | 36.3 | 20.4 | 42.2 | 27.4 | 43.4 | 43.4 | 69.0 | 43.9 | 40.7 | 68.1 |
| 54. CA593033 | 37.5 | 39.8 | 37.5 | 33.6 | 21.1 | 37.5 | 28.4 | 38.3 | 38.3 | 61.7 | 39.1 | 32.8 | 60.9 |
| 55. CK153563 | 56.1 | 49.5 | 46.6 | 56.4 | 41.5 | 70.7 | 24.4 | 53.2 | 56.3 | 42.6 | 63.2 | 85.1 | 42.6 |
| 56. TA66038_4565 | 46.5 | 48.5 | 48.5 | 49.0 | 28.6 | 35.3 | 28.9 | 51.0 | 51.5 | 82.7 | 44.7 | 47.5 | 81.6 |
| 57. TA52915_4565 | 44.7 | 60.2 | 57.3 | 45.7 | 27.2 | 39.7 | 21.4 | 98.9 | 54.4 | 56.4 | 41.2 | 49.5 | 55.3 |
| 58. TA69821_4565 | 45.6 | 39.3 | 44.9 | 48.6 | 29.0 | 38.8 | 48.3 | 39.3 | 58.9 | 52.3 | 44.7 | 43.9 | 51.4 |
| 59. TA95153_4565 | 44.4 | 44.4 | 43.6 | 37.6 | 23.1 | 35.0 | 25.4 | 47.9 | 41.9 | 41.0 | 35.9 | 38.5 | 40.2 |
| 60. CD899399 | 45.6 | 48.5 | 49.5 | 49.0 | 27.6 | 37.1 | 27.4 | 52.0 | 51.5 | 87.8 | 43.9 | 44.6 | 86.7 |
| 61. TA77646_4565 | 57.0 | 51.5 | 50.5 | 52.5 | 40.4 | 80.2 | 24.4 | 51.5 | 59.2 | 41.4 | 71.9 | 94.1 | 42.4 |
| 62. TA51752_4565 | 41.9 | 40.3 | 40.3 | 38.0 | 20.2 | 31.8 | 28.9 | 44.2 | 41.1 | 38.8 | 34.9 | 34.9 | 36.4 |
| 63. Pop_GASA | 45.6 | 44.7 | 48.5 | 53.2 | 36.0 | 42.2 | 27.9 | 43.5 | 48.5 | 58.5 | 43.0 | 50.5 | 58.5 |
| 64. Mt_GASA | 48.2 | 49.1 | 54.5 | 41.1 | 28.6 | 43.1 | 26.4 | 49.1 | 47.3 | 46.4 | 41.2 | 44.6 | 46.4 |
| 65. At2g30810 | 61.4 | 48.1 | 49.1 | 55.7 | 35.8 | 50.0 | 27.9 | 47.2 | 66.0 | 44.3 | 57.9 | 60.4 | 47.2 |
| 66. At3g02885 | 55.3 | 46.6 | 48.5 | 52.6 | 36.1 | 54.3 | 24.9 | 51.5 | 66.0 | 51.5 | 55.3 | 65.3 | 52.6 |
| 67. At5g15230 | 56.1 | 43.4 | 52.8 | 51.9 | 37.7 | 55.2 | 26.9 | 43.4 | 57.5 | 43.4 | 56.1 | 64.2 | 44.3 |
| 68. At1g74670 | 63.2 | 43.7 | 53.4 | 51.5 | 37.6 | 56.0 | 24.4 | 47.5 | 57.3 | 48.5 | 54.4 | 64.4 | 48.5 |

| | 53 | 54 | 55 | 56 | 57 | 58 | 59 | 60 | 61 | 62 | 63 | 64 | 65 |
|---|---|---|---|---|---|---|---|---|---|---|---|---|---|
| 1. TA5035_4679 | 30.1 | 25.8 | 51.1 | 36.7 | 34.8 | 30.6 | 23.9 | 35.7 | 52.5 | 21.7 | 34.8 | 26.8 | 48.6 |
| 2. TA5923_4679 | 29.1 | 26.3 | 45.4 | 35.2 | 30.3 | 30.6 | 29.3 | 34.4 | 47.1 | 29.5 | 32.8 | 32.5 | 47.9 |
| 3. Os05g0376800 | 20.7 | 19.6 | 32.2 | 27.1 | 26.3 | 28.6 | 24.0 | 25.8 | 33.6 | 27.9 | 23.7 | 27.5 | 35.5 |
| 4. Os04g0465300 | 27.6 | 24.6 | 33.3 | 31.5 | 40.0 | 31.2 | 32.5 | 33.3 | 33.3 | 27.9 | 32.4 | 38.1 | 36.7 |
| 5. Os10g0115550 | 32.5 | 27.7 | 43.6 | 29.9 | 32.5 | 32.2 | 25.0 | 29.1 | 46.2 | 22.0 | 33.1 | 31.3 | 43.9 |
| 6. AK105729 | 51.5 | 47.0 | 30.8 | 64.4 | 36.8 | 36.1 | 30.8 | 68.6 | 30.6 | 33.6 | 43.6 | 31.4 | 31.6 |
| 7. Os05g0432200 | 30.7 | 27.9 | 38.3 | 44.9 | 70.7 | 33.3 | 37.3 | 42.9 | 38.4 | 34.9 | 36.6 | 38.6 | 34.9 |
| 8. Os09g0414900 | 25.9 | 23.4 | 46.2 | 32.5 | 29.1 | 32.8 | 24.4 | 31.7 | 51.3 | 29.2 | 30.8 | 28.9 | 50.0 |
| 9. Os03g0607200 | 40.4 | 37.2 | 31.7 | 51.5 | 34.7 | 36.6 | 31.1 | 51.5 | 32.4 | 29.0 | 40.4 | 33.0 | 27.5 |
| 10. Os07g0592000 | 32.3 | 31.2 | 32.0 | 40.2 | 31.1 | 70.0 | 27.7 | 41.1 | 34.3 | 26.9 | 39.8 | 28.4 | 32.4 |
| 11. AK110640 | 30.7 | 27.9 | 38.3 | 44.9 | 69.6 | 33.3 | 36.4 | 42.9 | 38.4 | 34.1 | 36.6 | 37.7 | 34.9 |
| 12. Os06g0266800 | 31.0 | 24.4 | 64.9 | 36.7 | 37.6 | 29.6 | 29.1 | 34.7 | 67.7 | 24.0 | 37.1 | 28.6 | 46.2 |
| 13. Os03g0760800 | 63.7 | 57.0 | 39.2 | 78.6 | 45.3 | 41.4 | 32.8 | 82.7 | 37.5 | 29.8 | 54.8 | 34.8 | 34.9 |
| 14. scaff_205.30 | 39.4 | 36.6 | 37.9 | 42.9 | 30.4 | 39.8 | 29.1 | 44.6 | 40.8 | 29.0 | 55.3 | 31.9 | 33.9 |
| 15. scaff_II.204 | 34.1 | 29.7 | 37.6 | 37.5 | 50.0 | 32.4 | 32.5 | 39.4 | 37.9 | 29.5 | 33.7 | 43.4 | 37.0 |
| 16. scaff_II.2330 | 27.3 | 22.8 | 41.5 | 31.5 | 29.8 | 30.9 | 25.2 | 31.5 | 41.5 | 22.5 | 29.8 | 34.7 | 43.0 |
| 17. scaff_VI.397 | 25.4 | 22.6 | 47.0 | 34.0 | 32.0 | 32.4 | 27.4 | 33.0 | 48.0 | 26.4 | 32.0 | 31.3 | 46.2 |
| 18. scf_XVII.377 | 30.2 | 24.3 | 49.5 | 35.5 | 36.4 | 35.5 | 24.8 | 34.5 | 53.3 | 25.6 | 32.7 | 31.6 | 49.5 |
| 19. scaff_II.202 | 34.2 | 28.8 | 39.6 | 38.8 | 54.7 | 33.3 | 33.3 | 40.8 | 39.4 | 32.6 | 34.7 | 40.2 | 36.1 |
| 20. scaff_I.2410 | 38.1 | 35.2 | 40.0 | 50.0 | 36.6 | 32.4 | 29.7 | 50.0 | 36.4 | 26.9 | 69.2 | 31.9 | 31.2 |
| 21. scaff_I.1483 | 28.1 | 25.3 | 51.3 | 35.3 | 33.6 | 32.2 | 28.6 | 35.3 | 54.0 | 30.2 | 34.5 | 35.3 | 49.6 |
| 22. scaff_I.1926 | 11.6 | 8.6 | 15.9 | 14.5 | 19.2 | 17.4 | 16.7 | 15.3 | 16.3 | 17.5 | 15.9 | 22.4 | 17.1 |
| 23. scaff_XII.704 | 24.6 | 22.5 | 28.4 | 33.3 | 44.1 | 22.9 | 25.4 | 33.3 | 27.0 | 23.8 | 30.0 | 42.9 | 25.2 |
| 24. scaff_41.75 | 35.4 | 30.5 | 43.2 | 46.9 | 56.5 | 34.5 | 32.5 | 48.0 | 42.6 | 30.2 | 36.3 | 37.5 | 36.8 |
| 25. scaff_40.379 | 44.2 | 40.6 | 43.6 | 57.6 | 39.1 | 40.7 | 27.4 | 54.1 | 40.4 | 25.6 | 71.9 | 36.6 | 34.0 |
| 26. scaff_XV.507 | 28.2 | 25.8 | 34.7 | 36.4 | 48.4 | 27.5 | 32.2 | 38.2 | 36.0 | 30.0 | 30.1 | 56.3 | 30.8 |

TABLE C2-continued

MatGAT results for global similarity and identity over the full length of the polypeptide sequences.

| | | | | | | | | | | | | | |
|---|---|---|---|---|---|---|---|---|---|---|---|---|---|
| 27. scaff__II.203 | 27.4 | 22.7 | 34.0 | 34.7 | 50.0 | 25.0 | 25.6 | 35.7 | 30.3 | 22.5 | 31.5 | 34.8 | 30.2 |
| 28. scaff__II.2328 | 33.3 | 27.3 | 56.7 | 38.8 | 38.9 | 35.2 | 29.2 | 38.8 | 55.9 | 27.9 | 38.9 | 35.7 | 52.8 |
| 29. scaff__XIX.758 | 25.7 | 21.1 | 37.2 | 32.7 | 42.4 | 24.8 | 27.4 | 33.7 | 34.3 | 24.0 | 36.0 | 42.9 | 33.0 |
| 30. TA45751__4081 | 40.7 | 37.5 | 37.2 | 49.0 | 32.6 | 33.3 | 23.9 | 49.0 | 35.4 | 22.5 | 57.3 | 26.8 | 29.2 |
| 31. TA48119__4081 | 22.0 | 20.2 | 23.3 | 27.5 | 32.2 | 26.4 | 29.9 | 27.5 | 25.3 | 26.0 | 22.6 | 43.0 | 27.4 |
| 32. TA35962__4081 | 29.4 | 26.2 | 33.3 | 35.5 | 48.1 | 30.6 | 37.6 | 37.4 | 36.5 | 34.1 | 34.6 | 40.2 | 36.1 |
| 33. BI208422 | 30.1 | 23.4 | 51.1 | 34.7 | 33.7 | 28.7 | 24.8 | 34.7 | 49.5 | 21.7 | 36.0 | 35.7 | 47.2 |
| 34. BG128975 | 28.9 | 25.3 | 50.0 | 30.4 | 36.6 | 33.3 | 25.6 | 30.4 | 50.0 | 25.6 | 27.7 | 33.6 | 49.6 |
| 35. TA52374__4081 | 32.8 | 30.2 | 37.5 | 38.3 | 43.8 | 32.5 | 34.2 | 40.9 | 43.8 | 33.3 | 35.7 | 40.7 | 39.1 |
| 36. TA37180__4081 | 31.4 | 24.8 | 51.0 | 34.3 | 37.5 | 30.6 | 25.6 | 33.3 | 49.5 | 24.0 | 35.4 | 36.6 | 49.1 |
| 37. BE353147 | 28.2 | 24.5 | 34.3 | 33.3 | 49.0 | 32.1 | 35.9 | 35.2 | 34.0 | 31.0 | 32.4 | 36.6 | 38.9 |
| 38. TA56938__4081 | 33.1 | 26.8 | 54.8 | 35.5 | 36.5 | 36.1 | 28.2 | 36.4 | 57.7 | 26.4 | 36.8 | 33.0 | 52.8 |
| 39. BG130916 | 28.3 | 24.2 | 47.9 | 33.7 | 33.7 | 27.8 | 23.1 | 32.7 | 44.0 | 23.3 | 36.0 | 27.7 | 43.4 |
| 40. SEQ ID NO: 276 | 27.2 | 24.5 | 46.5 | 35.9 | 34.2 | 34.5 | 32.5 | 35.0 | 48.2 | 31.0 | 32.5 | 34.8 | 50.9 |
| 41. TA41886__4081 | 28.8 | 25.0 | 41.0 | 34.0 | 47.6 | 33.3 | 31.6 | 34.9 | 39.8 | 29.5 | 35.9 | 36.2 | 33.0 |
| 42. TA36295__4081 | 30.4 | 27.1 | 38.5 | 36.9 | 43.0 | 30.6 | 31.6 | 36.9 | 39.8 | 27.9 | 36.5 | 44.6 | 38.7 |
| 43. TA56201__4081 | 28.4 | 26.7 | 42.1 | 40.2 | 35.1 | 39.4 | 28.2 | 40.4 | 41.0 | 30.2 | 39.4 | 33.0 | 38.3 |
| 44. AJ785329 | 19.3 | 19.4 | 37.9 | 26.3 | 24.7 | 22.2 | 18.8 | 25.3 | 36.0 | 16.3 | 28.9 | 21.4 | 31.8 |
| 45. CA725087 | 32.2 | 29.2 | 68.1 | 30.5 | 29.7 | 25.8 | 23.3 | 30.5 | 78.4 | 21.4 | 31.4 | 27.1 | 39.0 |
| 46. TA69823__4565 | 19.3 | 19.6 | 17.8 | 21.4 | 18.3 | 46.8 | 18.7 | 20.6 | 19.3 | 22.3 | 19.8 | 19.2 | 21.8 |
| 47. TA53297__4565 | 30.7 | 27.1 | 41.7 | 42.9 | 97.8 | 30.8 | 34.2 | 44.9 | 40.6 | 33.3 | 31.5 | 36.8 | 34.9 |
| 48. TA101332__4565 | 32.8 | 28.6 | 47.6 | 36.8 | 40.8 | 40.2 | 30.8 | 37.7 | 50.5 | 32.6 | 36.9 | 33.6 | 49.5 |
| 49. TA66036__4565 | 65.5 | 58.6 | 37.1 | 79.6 | 43.2 | 40.2 | 31.1 | 83.7 | 35.3 | 26.7 | 53.2 | 35.7 | 34.9 |
| 50. TA100367__4565 | 30.9 | 27.8 | 57.9 | 35.3 | 30.7 | 33.6 | 27.4 | 34.5 | 65.8 | 27.1 | 32.5 | 27.8 | 49.6 |
| 51. TA92393__4565 | 33.3 | 26.8 | 84.2 | 38.7 | 39.8 | 33.3 | 30.8 | 37.5 | 94.1 | 26.4 | 38.8 | 33.9 | 50.9 |
| 52. BM136027 | 64.6 | 57.8 | 37.1 | 78.6 | 42.1 | 39.3 | 30.3 | 82.7 | 36.3 | 28.2 | 53.2 | 35.7 | 37.6 |
| 53. CA705831 | | 81.3 | 35.3 | 65.8 | 31.6 | 31.0 | 25.4 | 68.4 | 33.9 | 24.0 | 45.1 | 26.9 | 31.3 |
| 54. CA593033 | 82.8 | | 28.2 | 60.6 | 27.9 | 30.1 | 23.5 | 61.4 | 27.2 | 22.4 | 41.4 | 23.5 | 24.5 |
| 55. CK153563 | 40.7 | 32.8 | | 41.6 | 37.2 | 32.4 | 28.2 | 41.6 | 87.9 | 26.4 | 40.4 | 31.3 | 50.0 |
| 56. TA66038__4565 | 71.7 | 65.6 | 50.0 | | 42.9 | 39.3 | 27.7 | 94.9 | 38.2 | 28.2 | 52.0 | 32.2 | 34.9 |
| 57. TA52915__4565 | 43.4 | 38.3 | 52.1 | 51.0 | | 30.8 | 34.2 | 44.9 | 40.6 | 32.6 | 31.5 | 36.3 | 35.8 |
| 58. TA69821__4565 | 44.2 | 40.6 | 42.1 | 49.5 | 39.3 | | 28.8 | 38.2 | 33.3 | 27.7 | 37.6 | 27.8 | 34.2 |
| 59. TA95153__4565 | 41.0 | 38.3 | 35.9 | 38.5 | 48.7 | 39.3 | | 28.6 | 29.9 | 76.7 | 31.6 | 31.4 | 26.5 |
| 60. CD899399 | 72.6 | 64.8 | 49.0 | 96.9 | 52.0 | 47.7 | 36.8 | | 38.2 | 29.0 | 53.1 | 33.0 | 36.7 |
| 61. TA77646__4565 | 41.6 | 33.6 | 88.9 | 44.4 | 51.5 | 45.8 | 38.5 | 46.5 | | 27.1 | 39.6 | 33.9 | 51.9 |
| 62. TA51752__4565 | 38.0 | 38.8 | 34.1 | 38.8 | 45.0 | 39.5 | 82.9 | 37.2 | 34.9 | | 30.2 | 30.0 | 27.1 |
| 63. Pop__GASA | 50.4 | 45.3 | 52.1 | 61.2 | 44.6 | 49.5 | 39.3 | 61.2 | 52.5 | 39.5 | | 32.1 | 40.2 |
| 64. Mt__GASA | 43.4 | 39.1 | 41.1 | 46.4 | 48.2 | 42.0 | 43.6 | 47.3 | 46.4 | 42.6 | 46.4 | | 33.0 |
| 65. At2g30810 | 41.6 | 33.6 | 58.5 | 45.3 | 48.1 | 45.8 | 41.0 | 45.3 | 60.4 | 40.3 | 53.8 | 48.2 | |
| 66. At3g02885 | 46.9 | 38.3 | 64.9 | 51.0 | 51.5 | 45.8 | 41.0 | 52.0 | 66.7 | 37.2 | 54.6 | 47.3 | 61.3 |
| 67. At5g15230 | 38.1 | 33.6 | 62.3 | 48.1 | 42.5 | 43.0 | 39.3 | 48.1 | 65.1 | 38.8 | 46.2 | 49.1 | 55.7 |
| 68. At1g74670 | 42.5 | 37.5 | 64.4 | 48.5 | 46.5 | 45.8 | 40.2 | 47.5 | 68.3 | 39.5 | 50.5 | 47.3 | 64.2 |

| | 66 | 67 | 68 |
|---|---|---|---|
| 1. TA5035__4679 | 48.0 | 50.0 | 59.4 |
| 2. TA5923__4679 | 47.9 | 45.0 | 49.6 |
| 3. Os05g0376800 | 35.5 | 32.2 | 39.5 |
| 4. Os04g0465300 | 37.6 | 33.6 | 34.6 |
| 5. Os10g0115550 | 42.7 | 37.5 | 40.7 |
| 6. AK105729 | 33.9 | 31.7 | 34.2 |
| 7. Os05g0432200 | 39.2 | 31.1 | 37.6 |
| 8. Os09g0414900 | 47.0 | 41.9 | 47.0 |
| 9. Os03g0607200 | 34.0 | 30.3 | 27.9 |
| 10. Os07g0592000 | 38.8 | 27.9 | 33.3 |
| 11. AK110640 | 39.2 | 31.1 | 37.6 |
| 12. Os06g0266800 | 52.6 | 49.1 | 48.5 |
| 13. Os03g0760800 | 41.0 | 30.3 | 35.6 |
| 14. scaff__205.30 | 35.3 | 33.0 | 35.9 |
| 15. scaff__II.204 | 35.6 | 32.7 | 38.8 |
| 16. scaff__II.2330 | 45.5 | 36.4 | 40.5 |
| 17. scaff__VI.397 | 54.0 | 44.4 | 54.5 |
| 18. scf__XVII.377 | 55.5 | 67.6 | 63.6 |
| 19. scaff__II.202 | 40.2 | 33.0 | 38.2 |
| 20. scaff__I.2410 | 35.1 | 31.1 | 31.7 |
| 21. scaff__I.1483 | 51.3 | 52.2 | 53.1 |
| 22. scaff__I.1926 | 15.9 | 14.7 | 14.7 |
| 23. scaff__XII.704 | 27.6 | 25.2 | 29.4 |
| 24. scaff__41.75 | 43.3 | 33.0 | 37.6 |
| 25. scaff__40.379 | 44.3 | 38.7 | 35.6 |
| 26. scaff__XV.507 | 37.0 | 30.8 | 38.2 |
| 27. scaff__II.203 | 32.0 | 25.5 | 30.7 |
| 28. scaff__II.2328 | 64.9 | 47.2 | 54.5 |
| 29. scaff__XIX.758 | 36.1 | 34.0 | 35.6 |
| 30. TA45751__4081 | 33.0 | 29.2 | 31.7 |

TABLE C2-continued

MatGAT results for global similarity and identity over the full length of the polypeptide sequences.

| | | | |
|---|---|---|---|
| 31. TA48119_4081 | 28.8 | 24.0 | 27.4 |
| 32. TA35962_4081 | 35.6 | 34.0 | 38.5 |
| 33. BI208422 | 57.7 | 45.3 | 54.5 |
| 34. BG128975 | 54.0 | 47.8 | 53.6 |
| 35. TA52374_4081 | 33.3 | 31.3 | 36.8 |
| 36. TA37180_4081 | 61.0 | 49.5 | 58.3 |
| 37. BE353147 | 34.6 | 31.8 | 34.3 |
| 38. TA56938_4081 | 55.1 | 63.2 | 64.4 |
| 39. BG130916 | 48.5 | 42.5 | 48.5 |
| 40. SEQ ID NO: 276 | 46.5 | 43.9 | 53.5 |
| 41. TA41886_4081 | 35.9 | 33.3 | 34.0 |
| 42. TA36295_4081 | 35.9 | 40.0 | 41.3 |
| 43. TA56201_4081 | 42.4 | 37.6 | 40.2 |
| 44. AJ785329 | 32.7 | 32.7 | 33.3 |
| 45. CA725087 | 45.3 | 42.7 | 42.4 |
| 46. TA69823_4565 | 21.8 | 17.8 | 21.3 |
| 47. TA53297_4565 | 41.2 | 35.8 | 32.7 |
| 48. TA101332_4565 | 51.9 | 41.5 | 45.6 |
| 49. TA66036_4565 | 41.0 | 30.3 | 35.6 |
| 50. TA100367_4565 | 43.6 | 45.6 | 42.1 |
| 51. TA92393_4565 | 53.8 | 54.2 | 49.5 |
| 52. BM136027 | 42.0 | 31.2 | 35.6 |
| 53. CA705831 | 36.1 | 23.4 | 31.7 |
| 54. CA593033 | 29.9 | 21.0 | 27.5 |
| 55. CK153563 | 55.7 | 52.3 | 51.5 |
| 56. TA66038_4565 | 39.2 | 33.0 | 36.5 |
| 57. TA52915_4565 | 41.2 | 34.9 | 32.7 |
| 58. TA69821_4565 | 37.0 | 28.7 | 33.3 |
| 59. TA95153_4565 | 31.1 | 29.1 | 30.8 |
| 60. CD899399 | 41.7 | 33.0 | 35.6 |
| 61. TA77646_4565 | 58.6 | 54.2 | 53.5 |
| 62. TA51752_4565 | 28.7 | 28.7 | 26.4 |
| 63. Pop_GASA | 38.4 | 33.0 | 38.2 |
| 64. Mt_GASA | 33.0 | 30.1 | 33.9 |
| 65. At2g30810 | 50.9 | 45.3 | 50.9 |
| 66. At3g02885 | | 50.0 | 54.4 |
| 67. At5g15230 | 61.3 | | 57.5 |
| 68. At1g74670 | 65.3 | 67.9 | |

3.4. Auxin/Indoleacetic Acid Genes (AUX/IAA)

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix.

Parameters that may be used in the comparison:

Scoring matrix: Blosum62

First Gap: 12

Extending gap: 2

3.5. IAA14 Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table C3 for the global similarity and identity over the full length of the polypeptide sequences. Percentage identity is given above the diagonal and percentage similarity is given below the diagonal.

The percentage identity between the IAA14-like polypeptide sequences useful in performing the methods of the invention can be as low as 26.3% amino acid identity compared to SEQ ID NO: 738 (*A. thaliana*_AT4G14550.1), but is usually above 35%.

TABLE C3

MatGAT results for global similarity and identity over the full length of the polypeptide sequences.

| | 1 | 2 | 3 | 4 | 5 | 6 | 7 | 8 | 9 | 10 | 11 | 12 |
|---|---|---|---|---|---|---|---|---|---|---|---|---|
| 1. A. thaliana__AT4G14550.1#1 | | 80.7 | 68.6 | 63.6 | 70.5 | 73.7 | 67.2 | 66.8 | 26.3 | 54.5 | 61.4 | 64.2 |
| 2. A. thaliana__AT3G23050.1#1 | 84.8 | | 86.4 | 63.3 | 68.1 | 70.2 | 63.9 | 63.5 | 24.7 | 55.8 | 60.2 | 64.3 |
| 3. A. thaliana__AT3G23050.2#1 | 76.3 | 86.4 | | 53.6 | 57.5 | 58.6 | 53.5 | 53.6 | 12.0 | 45.0 | 49.2 | 53.2 |
| 4. P. trichocarpa__566151#1 | 72.2 | 72.9 | 61.4 | | 85.6 | 66.9 | 63.3 | 57.3 | 21.3 | 56.6 | 57.8 | 54.5 |
| 5. P. trichocarpa__720961#1 | 79.0 | 81.0 | 68.5 | 87.4 | | 74.3 | 70.9 | 63.9 | 23.8 | 54.2 | 63.6 | 59.9 |
| 6. M. truncatula__TA20354__3880#1 | 81.4 | 79.8 | 69.1 | 75.8 | 83.5 | | 72.3 | 64.4 | 26.3 | 55.8 | 61.2 | 63.9 |
| 7. S. lycopersicum__TA40922__4081#1 | 76.3 | 77.4 | 66.9 | 70.4 | 78.2 | 83.1 | | 60.5 | 24.6 | 55.3 | 59.4 | 62.5 |
| 8. A. thaliana__AT1G04250.1#1 | 82.5 | 77.0 | 67.7 | 67.5 | 75.4 | 77.1 | 74.6 | | 22.3 | 50.2 | 55.5 | 59.3 |
| 9. O. sativa__CB657009#1 | 27.2 | 26.3 | 15.2 | 23.1 | 25.4 | 26.7 | 25.8 | 26.6 | | 23.8 | 24.1 | 25.4 |
| 10. O. sativa__TA41733__4530#1 | 64.6 | 66.8 | 55.2 | 71.1 | 67.9 | 66.8 | 63.9 | 59.9 | 23.8 | | 55.7 | 54.2 |
| 11. M. truncatula__TA20951__3880#1 | 71.9 | 73.1 | 60.5 | 69.0 | 76.3 | 71.5 | 69.6 | 68.4 | 25.7 | 67.1 | | 63.5 |
| 12. A. thaliana__AT3G04730.1#1 | 75.8 | 77.8 | 66.5 | 67.9 | 75.8 | 78.8 | 77.1 | 74.6 | 27.5 | 64.6 | 73.5 | |
| 13. S. lycopersicum__TA48108__4081#1 | 69.7 | 67.9 | 63.3 | 62.1 | 68.5 | 72.0 | 69.5 | 71.2 | 29.8 | 56.0 | 66.8 | 71.6 |
| 14. M. truncatula__TA27011__3880#1 | 58.5 | 59.5 | 51.2 | 61.5 | 60.9 | 59.2 | 57.5 | 54.8 | 18.7 | 55.2 | 58.5 | 58.2 |
| 15. M. truncatula__TA22814__3880#1 | 71.0 | 72.2 | 60.0 | 65.7 | 72.2 | 74.3 | 71.4 | 71.4 | 25.7 | 59.6 | 70.4 | 71.4 |
| 16. P. trichocarpa__643213#1 | 75.9 | 75.7 | 64.6 | 68.2 | 74.2 | 79.7 | 78.9 | 74.3 | 27.0 | 66.4 | 73.9 | 76.8 |
| 17. A. thaliana__AT3G23030.1#1 | 51.8 | 48.1 | 47.6 | 44.0 | 48.8 | 50.8 | 49.2 | 52.8 | 25.3 | 44.0 | 47.8 | 48.7 |
| 18. A. thaliana__AT4G14560.1#1 | 53.5 | 48.6 | 48.6 | 46.2 | 50.0 | 53.0 | 51.3 | 54.1 | 29.8 | 45.5 | 50.6 | 52.1 |
| 19. A. thaliana__AT1G04240.1#1 | 54.8 | 53.5 | 53.3 | 46.9 | 53.6 | 54.7 | 53.0 | 55.0 | 26.5 | 47.7 | 53.8 | 54.2 |
| 20. S. lycopersicum__TA38817__4081#1 | 54.8 | 52.7 | 52.4 | 46.2 | 51.2 | 49.2 | 51.3 | 52.0 | 23.7 | 44.8 | 50.2 | 50.4 |
| 21. S. lycopersicum__TA43058__4081#1 | 55.3 | 53.1 | 53.3 | 48.4 | 55.6 | 53.8 | 51.3 | 56.8 | 23.0 | 47.3 | 53.4 | 55.1 |
| 22. P. trichocarpa__726443#1 | 54.4 | 53.5 | 53.8 | 43.3 | 48.8 | 52.1 | 49.2 | 55.0 | 24.0 | 48.0 | 48.6 | 55.5 |
| 23. P. trichocarpa__564913#1 | 57.9 | 52.7 | 51.4 | 48.7 | 51.6 | 54.7 | 53.4 | 59.8 | 23.2 | 51.6 | 51.4 | 53.8 |
| 24. P. trichocarpa__831610#1 | 57.9 | 56.0 | 55.7 | 49.8 | 54.8 | 56.4 | 55.5 | 57.2 | 25.1 | 50.2 | 53.0 | 58.1 |
| 25. P. trichocarpa__798526#1 | 56.6 | 55.1 | 54.8 | 48.4 | 54.8 | 57.6 | 55.9 | 57.6 | 23.6 | 49.1 | 53.8 | 57.6 |
| 26. M. truncatula__TA20557__3880#1 | 55.7 | 53.9 | 53.8 | 44.8 | 50.4 | 52.5 | 51.7 | 55.0 | 26.4 | 47.3 | 50.6 | 53.0 |
| 27. M. truncatula__TA20558__3880#1 | 55.3 | 49.8 | 49.0 | 46.9 | 53.6 | 51.7 | 53.8 | 54.1 | 26.3 | 48.0 | 50.6 | 55.9 |
| 28. P. trichocarpa__823671#1 | 58.3 | 53.9 | 54.3 | 48.0 | 54.0 | 56.4 | 54.7 | 57.6 | 23.2 | 49.8 | 53.8 | 55.5 |
| 29. P. trichocarpa__595419#1 | 57.0 | 55.1 | 55.7 | 47.3 | 53.6 | 55.9 | 54.7 | 55.9 | 23.4 | 48.4 | 52.6 | 53.8 |
| 30. M. truncatula__TA31746__3880#1 | 56.6 | 55.1 | 54.8 | 49.5 | 54.0 | 53.8 | 53.8 | 58.5 | 25.0 | 48.4 | 54.2 | 55.9 |
| 31. S. lycopersicum__TA42190__4081#1 | 54.4 | 53.9 | 52.9 | 49.5 | 55.2 | 55.9 | 53.8 | 54.1 | 25.9 | 50.9 | 54.2 | 55.5 |
| 32. A. thaliana__AT4G29080.1#1 | 53.1 | 54.4 | 44.9 | 57.7 | 55.1 | 54.4 | 50.8 | 52.1 | 19.3 | 57.7 | 58.0 | 53.8 |
| 33. M. truncatula__TA25400__3880#1 | 46.5 | 43.2 | 35.7 | 37.2 | 41.5 | 41.9 | 43.6 | 45.0 | 45.5 | 40.4 | 41.5 | 44.1 |
| 34. P. trichocarpa__711734#1 | 47.0 | 49.6 | 41.0 | 51.0 | 48.1 | 48.7 | 48.1 | 48.1 | 17.8 | 51.3 | 53.3 | 48.7 |
| 35. P. trichocarpa__584053#1 | 51.8 | 56.7 | 46.6 | 53.7 | 55.4 | 53.4 | 55.7 | 53.1 | 20.2 | 57.0 | 56.0 | 53.4 |
| 36. M. truncatula__TA23062__3880#1 | 46.4 | 50.1 | 41.5 | 50.4 | 47.6 | 46.1 | 47.0 | 48.4 | 17.9 | 51.6 | 50.7 | 47.8 |

| | 13 | 14 | 15 | 16 | 17 | 18 | 19 | 20 | 21 | 22 | 23 | 24 |
|---|---|---|---|---|---|---|---|---|---|---|---|---|
| 1. A. thaliana__AT4G14550.1#1 | 58.5 | 49.3 | 62.5 | 63.2 | 40.6 | 42.3 | 41.8 | 41.8 | 42.7 | 43.5 | 45.6 | 45.5 |
| 2. A. thaliana__AT3G23050.1#1 | 57.3 | 48.4 | 61.2 | 62.0 | 39.8 | 38.9 | 43.0 | 40.2 | 41.6 | 41.4 | 41.5 | 45.3 |
| 3. A. thaliana__AT3G23050.2#1 | 46.1 | 41.9 | 50.4 | 50.2 | 35.0 | 35.3 | 37.9 | 34.6 | 36.5 | 38.3 | 36.0 | 39.7 |
| 4. P. trichocarpa__566151#1 | 54.3 | 44.3 | 56.4 | 56.6 | 36.6 | 37.5 | 38.8 | 38.1 | 38.8 | 36.5 | 41.2 | 40.8 |
| 5. P. trichocarpa__720961#1 | 58.3 | 46.9 | 60.8 | 61.2 | 38.8 | 39.9 | 43.8 | 42.0 | 44.2 | 40.3 | 42.7 | 43.5 |
| 6. M. truncatula__TA20354__3880#1 | 61.3 | 50.2 | 64.7 | 68.0 | 42.2 | 42.8 | 44.5 | 42.7 | 43.5 | 41.8 | 44.6 | 45.8 |
| 7. S. lycopersicum__TA40922__4081#1 | 61.6 | 45.0 | 60.7 | 64.3 | 39.3 | 41.3 | 44.6 | 40.5 | 42.7 | 39.8 | 41.9 | 45.0 |
| 8. A. thaliana__AT1G04250.1#1 | 58.6 | 44.3 | 58.8 | 59.3 | 43.3 | 42.8 | 45.9 | 41.5 | 45.5 | 41.6 | 46.1 | 45.4 |
| 9. O. sativa__CB657009#1 | 26.9 | 16.4 | 24.1 | 24.9 | 20.9 | 22.9 | 21.3 | 20.2 | 20.1 | 19.0 | 20.0 | 21.5 |
| 10. O. sativa__TA41733__4530#1 | 50.0 | 42.0 | 49.8 | 57.0 | 34.9 | 36.6 | 37.9 | 37.5 | 38.9 | 39.9 | 42.0 | 43.4 |
| 11. M. truncatula__TA20951__3880#1 | 57.6 | 47.2 | 61.2 | 64.7 | 37.9 | 39.9 | 43.5 | 39.1 | 43.5 | 39.9 | 40.9 | 45.5 |
| 12. A. thaliana__AT3G04730.1#1 | 60.2 | 45.9 | 57.8 | 62.5 | 40.3 | 41.9 | 42.5 | 39.2 | 43.8 | 41.1 | 42.2 | 45.2 |
| 13. S. lycopersicum__TA48108__4081#1 | | 45.2 | 58.7 | 60.9 | 43.9 | 46.2 | 47.4 | 44.1 | 47.2 | 43.5 | 44.9 | 47.2 |
| 14. M. truncatula__TA27011__3880#1 | 52.8 | | 57.5 | 55.5 | 30.1 | 32.0 | 34.7 | 31.9 | 33.7 | 32.2 | 33.0 | 32.3 |
| 15. M. truncatula__TA22814__3880#1 | 66.9 | 67.6 | | 67.7 | 39.6 | 43.5 | 43.7 | 42.0 | 42.5 | 40.0 | 41.9 | 41.9 |
| 16. P. trichocarpa__643213#1 | 70.0 | 64.5 | 78.0 | | 40.1 | 43.5 | 41.8 | 40.4 | 40.6 | 41.3 | 44.4 | 45.6 |
| 17. A. thaliana__AT3G23030.1#1 | 53.4 | 39.5 | 50.6 | 49.4 | | 75.0 | 57.5 | 61.7 | 62.4 | 60.7 | 57.5 | 60.5 |
| 18. A. thaliana__AT4G14560.1#1 | 56.7 | 41.1 | 50.6 | 52.3 | 85.1 | | 60.2 | 60.5 | 59.7 | 59.8 | 57.2 | 59.0 |
| 19. A. thaliana__AT1G04240.1#1 | 61.5 | 42.8 | 50.6 | 53.2 | 68.3 | 69.8 | | 62.6 | 65.5 | 59.8 | 57.1 | 58.1 |
| 20. S. lycopersicum__TA38817__4081#1 | 56.3 | 43.8 | 52.2 | 52.3 | 71.6 | 68.9 | 75.3 | | 77.6 | 67.2 | 65.6 | 63.4 |
| 21. S. lycopersicum__TA43058__4081#1 | 60.6 | 43.5 | 51.4 | 52.3 | 68.9 | 67.9 | 75.5 | 84.2 | | 66.3 | 63.3 | 64.9 |
| 22. P. trichocarpa__726443#1 | 59.1 | 41.5 | 50.6 | 52.3 | 69.8 | 66.7 | 73.4 | 80.2 | 77.0 | | 83.7 | 68.3 |
| 23. P. trichocarpa__564913#1 | 60.1 | 41.8 | 51.8 | 56.5 | 65.7 | 63.8 | 70.0 | 73.9 | 73.4 | 87.0 | | 66.2 |
| 24. P. trichocarpa__831610#1 | 62.0 | 42.8 | 51.8 | 57.4 | 69.2 | 68.2 | 73.3 | 74.4 | 76.5 | 79.5 | 74.4 | |
| 25. P. trichocarpa__798526#1 | 61.1 | 43.8 | 51.0 | 57.0 | 67.3 | 67.3 | 70.4 | 73.9 | 76.4 | 77.4 | 73.9 | 95.0 |
| 26. M. truncatula__TA20557__3880#1 | 57.2 | 42.1 | 50.6 | 54.9 | 75.8 | 74.7 | 75.1 | 75.3 | 74.5 | 80.7 | 73.4 | 77.4 |
| 27. M. truncatula__TA20558__3880#1 | 60.1 | 42.1 | 50.2 | 54.0 | 67.2 | 68.8 | 74.1 | 77.9 | 75.0 | 78.6 | 74.4 | 80.0 |
| 28. P. trichocarpa__823671#1 | 62.0 | 44.8 | 52.2 | 56.5 | 63.5 | 63.1 | 71.9 | 75.4 | 74.9 | 75.9 | 73.9 | 80.3 |
| 29. P. trichocarpa__595419#1 | 63.0 | 45.2 | 53.9 | 53.2 | 67.7 | 64.2 | 73.1 | 77.6 | 74.6 | 76.6 | 72.0 | 81.1 |
| 30. M. truncatula__TA31746__3880#1 | 61.1 | 42.1 | 52.7 | 56.1 | 63.2 | 65.7 | 71.1 | 70.6 | 72.1 | 72.5 | 71.5 | 82.8 |
| 31. S. lycopersicum__TA42190__4081#1 | 58.7 | 44.1 | 51.4 | 55.3 | 68.6 | 71.4 | 75.7 | 72.6 | 74.0 | 75.0 | 67.6 | 76.4 |
| 32. A. thaliana__AT4G29080.1#1 | 49.8 | 51.1 | 54.4 | 55.1 | 42.0 | 41.3 | 47.9 | 44.3 | 44.9 | 45.6 | 46.9 | 48.5 |
| 33. M. truncatula__TA25400__3880#1 | 49.5 | 33.4 | 42.4 | 45.1 | 44.8 | 50.0 | 42.3 | 41.6 | 39.8 | 39.6 | 40.6 | 41.5 |
| 34. P. trichocarpa__711734#1 | 45.6 | 49.9 | 48.7 | 49.3 | 35.5 | 37.5 | 38.7 | 37.2 | 38.7 | 39.0 | 40.4 | 40.4 |
| 35. P. trichocarpa__584053#1 | 50.2 | 51.8 | 53.7 | 53.7 | 39.4 | 41.0 | 42.7 | 42.0 | 43.3 | 44.0 | 44.6 | 44.0 |
| 36. M. truncatula__TA23062__3880#1 | 43.8 | 47.0 | 47.3 | 48.7 | 35.7 | 36.3 | 39.8 | 38.9 | 37.8 | 39.8 | 38.9 | 41.5 |

TABLE C3-continued

MatGAT results for global similarity and identity over the full length of the polypeptide sequences.

| | 25 | 26 | 27 | 28 | 29 | 30 | 31 | 32 | 33 | 34 | 35 | 36 |
|---|---|---|---|---|---|---|---|---|---|---|---|---|
| 1. A. thaliana__AT4G14550.1#1 | 43.1 | 42.9 | 44.0 | 43.2 | 41.7 | 44.4 | 42.4 | 43.0 | 36.1 | 38.4 | 43.3 | 36.5 |
| 2. A. thaliana__AT3G23050.1#1 | 41.8 | 41.9 | 40.7 | 42.6 | 42.4 | 43.8 | 42.3 | 43.1 | 33.9 | 39.1 | 43.2 | 37.3 |
| 3. A. thaliana__AT3G23050.2#1 | 36.6 | 37.4 | 35.0 | 37.4 | 37.3 | 38.2 | 36.6 | 35.7 | 25.0 | 31.7 | 35.1 | 31.5 |
| 4. P. trichocarpa__566151#1 | 38.6 | 37.9 | 36.5 | 39.7 | 37.9 | 40.4 | 38.3 | 41.8 | 31.5 | 40.0 | 41.7 | 37.0 |
| 5. P. trichocarpa__720961#1 | 43.5 | 42.3 | 41.1 | 44.8 | 42.7 | 43.5 | 42.3 | 43.3 | 34.8 | 39.5 | 43.6 | 36.6 |
| 6. M. truncatula__TA20354__3880#1 | 43.9 | 42.3 | 40.8 | 44.6 | 42.6 | 43.3 | 43.9 | 43.6 | 35.3 | 39.3 | 41.9 | 36.7 |
| 7. S. lycopersicum__TA40922__4081#1 | 42.3 | 39.0 | 41.9 | 42.1 | 42.6 | 44.1 | 41.8 | 43.6 | 37.4 | 41.5 | 45.9 | 37.6 |
| 8. A. thaliana__AT1G04250.1#1 | 44.6 | 40.8 | 43.2 | 45.9 | 42.4 | 44.0 | 42.4 | 42.6 | 35.9 | 37.4 | 41.2 | 36.4 |
| 9. O. sativa__CB657009#1 | 19.6 | 22.6 | 22.2 | 19.4 | 20.6 | 22.1 | 23.2 | 17.0 | 37.9 | 15.5 | 17.3 | 14.7 |
| 10. O. sativa__TA41733__4530#1 | 40.3 | 38.2 | 39.0 | 42.3 | 40.1 | 40.1 | 39.5 | 44.6 | 33.2 | 41.3 | 42.2 | 40.5 |
| 11. M. truncatula__TA20951__3880#1 | 43.9 | 40.7 | 39.5 | 44.1 | 43.3 | 42.9 | 45.5 | 48.0 | 34.9 | 42.4 | 45.0 | 40.9 |
| 12. A. thaliana__AT3G04730.1#1 | 42.9 | 42.4 | 42.8 | 41.9 | 43.0 | 41.2 | 44.9 | 42.0 | 35.7 | 37.5 | 41.4 | 36.7 |
| 13. S. lycopersicum__TA48108__4081#1 | 46.8 | 44.1 | 46.7 | 46.6 | 46.1 | 45.3 | 48.1 | 39.9 | 41.1 | 38.3 | 41.7 | 35.1 |
| 14. M. truncatula__TA27011__3880#1 | 33.0 | 33.7 | 33.3 | 33.9 | 33.8 | 35.3 | 35.0 | 33.7 | 26.6 | 31.1 | 33.1 | 30.4 |
| 15. M. truncatula__TA22814__3880#1 | 42.1 | 41.5 | 40.0 | 42.4 | 41.5 | 41.5 | 42.4 | 44.1 | 36.4 | 39.1 | 43.1 | 37.5 |
| 16. P. trichocarpa__643213#1 | 44.4 | 44.0 | 45.0 | 43.0 | 42.0 | 44.3 | 43.0 | 43.6 | 38.1 | 40.7 | 43.7 | 38.0 |
| 17. A. thaliana__AT3G23030.1#1 | 57.4 | 58.0 | 56.9 | 54.6 | 54.2 | 54.6 | 55.6 | 34.1 | 36.0 | 28.9 | 30.9 | 27.3 |
| 18. A. thaliana__AT4G14560.1#1 | 56.8 | 58.1 | 58.3 | 57.6 | 57.2 | 55.9 | 58.1 | 33.4 | 36.6 | 30.9 | 33.6 | 29.1 |
| 19. A. thaliana__AT1G04240.1#1 | 58.4 | 59.0 | 59.7 | 60.5 | 60.6 | 56.5 | 58.5 | 37.7 | 31.6 | 29.8 | 33.9 | 30.3 |
| 20. S. lycopersicum__TA38817__4081#1 | 61.9 | 62.6 | 64.2 | 61.8 | 62.4 | 61.2 | 59.3 | 35.4 | 31.9 | 29.5 | 33.2 | 30.3 |
| 21. S. lycopersicum__TA43058__4081#1 | 62.4 | 61.7 | 61.8 | 60.9 | 59.5 | 62.6 | 61.0 | 37.0 | 32.4 | 30.7 | 34.7 | 30.3 |
| 22. P. trichocarpa__726443#1 | 66.3 | 69.4 | 64.9 | 65.4 | 62.6 | 61.8 | 60.1 | 38.4 | 30.5 | 32.3 | 36.2 | 30.3 |
| 23. P. trichocarpa__564913#1 | 63.5 | 62.3 | 63.0 | 62.9 | 59.7 | 61.0 | 55.8 | 39.0 | 32.2 | 33.7 | 37.5 | 30.8 |
| 24. P. trichocarpa__831610#1 | 92.0 | 62.8 | 66.8 | 69.1 | 67.3 | 70.0 | 65.2 | 38.7 | 31.8 | 34.1 | 37.0 | 33.4 |
| 25. P. trichocarpa__798526#1 | | 62.3 | 64.5 | 66.8 | 65.0 | 69.1 | 62.2 | 37.4 | 31.7 | 33.2 | 36.2 | 33.1 |
| 26. M. truncatula__TA20557__3880#1 | 74.9 | | 69.4 | 60.9 | 61.0 | 58.8 | 59.0 | 36.7 | 33.2 | 27.8 | 32.9 | 29.7 |
| 27. M. truncatula__TA20558__3880#1 | 77.4 | 81.7 | | 65.0 | 63.7 | 61.5 | 56.3 | 33.8 | 33.5 | 30.1 | 35.5 | 31.7 |
| 28. P. trichocarpa__823671#1 | 80.8 | 72.9 | 75.4 | | 89.2 | 63.8 | 57.8 | 38.0 | 31.9 | 33.2 | 36.2 | 32.6 |
| 29. P. trichocarpa__595419#1 | 82.1 | 74.1 | 75.6 | 94.6 | | 62.7 | 57.8 | 39.7 | 31.7 | 31.5 | 35.5 | 32.3 |
| 30. M. truncatula__TA31746__3880#1 | 82.8 | 73.0 | 73.5 | 76.5 | 77.5 | | 60.1 | 38.8 | 31.6 | 33.5 | 38.4 | 34.8 |
| 31. S. lycopersicum__TA42190__4081#1 | 73.9 | 76.2 | 75.3 | 73.9 | 73.6 | 71.6 | | 37.7 | 32.1 | 30.9 | 38.1 | 29.1 |
| 32. A. thaliana__AT4G29080.1#1 | 48.2 | 43.3 | 44.9 | 47.2 | 47.9 | 46.9 | 45.9 | | 32.5 | 54.6 | 57.7 | 45.3 |
| 33. M. truncatula__TA25400__3880#1 | 42.2 | 44.9 | 44.1 | 41.9 | 40.8 | 40.2 | 44.3 | 36.7 | | 30.7 | 36.2 | 28.0 |
| 34. P. trichocarpa__711734#1 | 39.8 | 36.4 | 36.4 | 39.5 | 39.3 | 40.1 | 39.3 | 66.8 | 35.2 | | 61.4 | 49.1 |
| 35. P. trichocarpa__584053#1 | 44.6 | 43.0 | 42.0 | 46.3 | 45.0 | 46.9 | 46.3 | 69.4 | 39.1 | 69.1 | | 47.3 |
| 36. M. truncatula__TA23062__3880#1 | 41.8 | 38.9 | 39.8 | 40.6 | 40.6 | 43.2 | 38.6 | 58.5 | 32.0 | 65.6 | 59.7 | |

Example 4

Identification of Domains Comprised in Polypeptide Sequences Useful in Performing the Methods of the Invention

4.1. Aspartate AminoTransferase (ASPAT)

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 4, by SEQ ID NO: 2 and by SEQ ID NO: 6 are presented in Table D1, Table D2 and Table D3, respectively.

Tables D1, D2, D3: InterPro scan results (major accession numbers) of the polypeptide sequence as represented by SEQ ID NO: 4, SEQ ID NO: 2 and SEQ ID NO: 6 respectively.

TABLE D1

| Database | Accession number | Accession name | Amino Acid Coordinates in on SEQ ID NO: 2, (Start-End) | e-value |
|---|---|---|---|---|
| InterPro | IPR000796 | Aspartate/other aminotransferase | | |
| HMMPanther | PTHR11879 | ASPARTATE AMINOTRANSFERASE | [1-204] | 2.6e−123 |
| InterPro | IPR004839 | Aminotransferase, class I and II | class | |
| HMMPfam | PF00155 | Aminotran__1__2 | [31-203] | 8.3e−61 |
| InterPro | IPR015421 | Pyridoxal phosphate-dependent transferase, major region, subdomain | [50-203] | |
| Gene3D | G3DSA:3.40.640.10 | no description | description | 7.8e−57 |
| InterPro | IPR015424 | Pyridoxal phosphate-dependent transferase, | phosphate-dependent | |
| superfamily | SSF53383 | PLP-dependent transferases | [2-203] | 6.2e−56 |

TABLE D2

| Database | Accession number | Aspartate/other aminotransferase | Amino Acid Coordinates in on SEQ ID NO: 6, (Start-End) | e-value |
|---|---|---|---|---|
| InterPro | IPR000796 | Aspartate/other aminotransferase | | |
| FPrintScan | PR00799 | TRANSAMINASE | [234-253]; [265-279]; [301-321]; [401-419]; 427-445] | 5.9E−68 |
| HMMPanther | PTHR11879 | Asp_trans | [38-460] | 0.0 |
| InterPro | IPR004838 | Aminotransferases, class-I, pyridoxal-phosphate-binding site | | |
| ProfileScan | PS00105 | AA_TRANSFER_CLASS_1 | [303-316] | 8.0E−5 |
| InterPro | IPR004839 | Aminotransferase, class I and II | | |
| HMMPfam | PF00155 | Aminotran_1_2 | [84-452] | 0.0 |
| InterPro | IPR015421 | Pyridoxal phosphate-dependent transferase major region, subdomain I | | |
| Gene3D | G3DSA:3.40.640.10 | PyrdxlP-dep_Trfase_major_sub1 | [103-375] | 3.8E−111 |
| InterPro | IPR015424 | Pyridoxal phosphate-dependent transferase major region | | |
| superfamily | SSF53383 | PyrdxlP-dep_Trfase_major | [55-460] | 6.8E−121 |

TABLE D3

| Database | Accession number | Aspartate/other aminotransferase | Amino Acid Coordinates [Start-End] - Evalue |
|---|---|---|---|
| InterPro | IPR000796 | Aspartate/other aminotransferase | aminoransferase |
| FPrintScan | PR00799 | TRANSAMINASE | [179-198]; [210-224]; [246-266]; [278-303]; [346-364]; [372-390]; - 1.6e−70 |
| HMMPanther | PTHR11879 | ASPARTATE AMINOTRANSFERASE | [1-405] - 6.2e−259 |
| InterPro | IPR004838 | Aminotransferases, Class I pyridoxal-phosphate-binding site | |
| ScanRegExp | PS00105 | AA_TRANSFER_CLASS_1 | [248-261] - 0.00008 |
| InterPro | IPR004839 | Aminotransferase, class I and II | |
| HMMPfam | PF00155 | Aminotran_1_2 | [29-397] - 1.4e−140 |
| InterPro | IPR015421 | Pyridoxal phosphate-dependent transferase, major region subdomain I | |
| Gene3D | G3DSA:3.40.640.10 | no description | [48-320] - 1.7e−107 |
| InterPro | IPR015424 | Pyridoxal phosphate transferase major region | |
| superfamily | SSF53383 | PLP-dependent transferase | [1-405] - 1.3e−119 |

4.2. MYB91 Like Transcription Factor (MYB91)

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Interpro is hosted at the European Bioinformatics Institute in the United Kingdom.

The results of the InterPro scan of the polypeptide sequence as represented by SEQ ID NO: 221 are presented in Table D4.

TABLE D4

InterPro scan results of the polypeptide sequence as represented by SEQ ID NO: 221

| InterPro accession number and name | Integrated database Name | Integrated database accession number | Integrated database accession name |
|---|---|---|---|
| IPR001005 SANT, DNA-binding domain | SMART | SM00717 | SANT |
| IPR009057 homeodomain-like | SUPERFAMILY | SSF46689 | Homeodomain-like |
| IPR012287 Homeodomain-related | GENE3D | G3DSA:1.10.10.60 | |
| IPR014778 Myb, DNA-binding | PFAM | PF00249 | Myb_DNA-binding |
| IPR015495 Myb transcription factor | PANTHER | PTHR10641 | MYB-related |
| No IPR unintegrated | PANTHER | PTHR10641:SF24 | Assymetric leaves1 and Rough Sheath2 |
| No IPR unintegrated | PROFILE | PS51294 | HTH_MYB |

4.3. Gibberellic Acid-Stimulated *Arabidopsis* (GASA)

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 2 are presented in Table D5.

TABLE D5

InterPro scan results (major accession numbers) of the polypeptide sequence as represented by SEQ ID NO: 276.

| Database | Accession number | Accession name | Amino acid coordinates on SEQ ID NO 2 |
|---|---|---|---|
| InterPro | IPR003854 | Gibberellin regulated protein | |
| HMMPfam | PF02704 | GASA | 5-114 |

4.4. Auxin/Indoleacetic Acid Genes (AUX/IAA)

The presence of conserved protein domains in SEQ ID NO: 432 was determined by searching the pfam database. Pfam is a large collection of multiple sequence alignments and hidden Markov models covering many common protein domains and families. Pfam is hosted at the Sanger Institute server in the United Kingdom.

The results of the search of the Pfam with the query sequence as represented by SEQ ID NO: 432 are presented in Table D6.

TABLE D6

Pfam search results (major accession numbers) of the polypeptide sequence as represented by SEQ ID NO: 432.

| | | | Amino acid coordinate of domain PF02309 in SEQ ID NO: 2 | | HMM | | | | |
|---|---|---|---|---|---|---|---|---|---|
| Pfam-A | Description | Entry type | Start | End | From | To | Bits score | E-value | Alignment mode |
| AUX_IAA | AUX/IAA family | Family PF02309 | 5 | 171 | 1 | 269 | 70.3 | 6.9e−18 | ls |

The Alignment mode use is the so called "ls". Parameters used in the model are given in Table D7.

TABLE D7

HMM model
ls model: hmmbuild -F HMM_ls SEED
hmmcalibrate --cpu 1 --seed 0 HMM_ls

| | ls | |
|---|---|---|
| Parameter | Sequence | Domain |
| Gathering cut-off | −83 | −83 |
| Trusted cut-off | −82 | −82 |
| Noise cut-off | −83.5 | −83.5 |

4.5. IAA14 Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 738 are presented in Table D8.

TABLE D8

InterPro scan results (major accession numbers) of the polypeptide sequence as represented by SEQ ID NO: 738.

| Database | Accession number | Accession name | Amino acid coordinates on SEQ ID NO 738 |
|---|---|---|---|
| InterPro | IPR003311 | AUX/IAA protein | |
| HMMPfam | PF02309 | AUX_IAA | 1-220 |
| InterPro | IPR011525 | Aux/IAA-ARF-dimerisation | |
| ProfileScan | PS50962 | IAA_ARF | 111-211 |
| InterPro | NULL | NULL | |
| superfamily | SSF54277 | CAD & PB1 domains | 106-209 |

Example 5

Topology Prediction of the Polypeptide Sequences Useful in Performing the Methods of the Invention 5.1. Aspartate AminoTransferase (ASPAT)

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The protein sequences representing the GRP are used to query TargetP 1.1. The "plant" organism group is selected, no cutoffs defined, and the predicted length of the transit peptide requested.

Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

TMHMM, hosted on the server of the Technical University of Denmark 5.2. Gibberellic Acid-Stimulated *Arabidopsis* (GASA)

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 221 are presented Table E1. The "plant" organism group has been selected, no cutoffs defined, and the predicted length of the transit peptide requested. The polypeptide sequence as represented by SEQ ID NO: 221 is predicted to be secreted, with a secretion signal sequence of 24 amino acids.

TABLE E1

TargetP 1.1 analysis of the polypeptide sequence as represented by SEQ ID NO: 221

| | |
|---|---|
| Length (AA) | 114 |
| Chloroplastic transit peptide | 0.022 |
| Mitochondrial transit peptide | 0.022 |
| Secretory pathway signal peptide | 0.960 |
| Other subcellular targeting | 0.023 |
| Predicted Location | S |
| Reliability class | 1 |
| Predicted transit peptide length | 24 |

Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

TMHMM, hosted on the server of the Technical University of Denmark

PSORT (URL: psort.org)

PLOC (Park and Kanehisa, Bioinformatics, 19, 1656-1663, 2003).

5.3. Auxin/Indoleacetic Acid Genes (AUX/IAA)

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

TMHMM, hosted on the server of the Technical University of Denmark

PSORT (URL: psort.org)

PLOC (Park and Kanehisa, Bioinformatics, 19, 1656-1663, 2003).

5.4. IAA14 polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 738 are presented Table E2. The "plant" organism group has been selected, no cutoffs defined, and the predicted length of the transit peptide requested. The subcellular localization of the polypeptide sequence as represented by SEQ ID NO: 738 may be the cytoplasm or nucleus, no transit peptide is predicted.

TABLE E2

TargetP 1.1 analysis of the polypeptide sequence as represented by SEQ ID NO: 738.

| Name | Len | cTP | mTP | SP | other | Loc | RC | TPlen |
|---|---|---|---|---|---|---|---|---|
| AtIAA14 | 228 | 0.116 | 0.087 | 0.047 | 0.879 | — | 2 | — |
| cutoff | | 0.000 | 0.000 | 0.000 | 0.000 | | | |

Abbreviations:
Len, Length;
cTP, Chloroplastic transit peptide;
mTP, Mitochondrial transit peptide,
SP, Secretory pathway signal peptide,
other, Other subcellular targeting,
Loc, Predicted Location;
RC, Reliability class;
TPlen, Predicted transit peptide length.

Many other algorithms can be used to perform such analyses, including:

- ChloroP 1.1 hosted on the server of the Technical University of Denmark;
- Protein Prowler Subcellular Localisation Predictor version 1.2 hosted on the server of the Institute for Molecular Bioscience, University of Queensland, Brisbane, Australia;
- PENCE Proteome Analyst PA-GOSUB 2.5 hosted on the server of the University of Alberta, Edmonton, Alberta, Canada;
- TMHMM, hosted on the server of the Technical University of Denmark
- PSORT (URL: psort.org)
- PLOC (Park and Kanehisa, Bioinformatics, 19, 1656-1663, 2003).

PSORT analysis predicts a nuclear localisation, which is in agreement with the data from the literature (Fukaki et al., 2002).

Example 6

Subcellular Localisation Prediction of the Polypeptide Sequences Useful in Performing the Methods of the Invention 6.1. MYB91 Like Transcription Factor (MYB91)

Experimental methods for protein localization range from immunolocalization to tagging of proteins using green fluorescent protein (GFP) or beta-glucuronidase (GUS). Such methods to identify subcellular compartmentalisation of GRF polypeptides are well known in the art.

A predicted nuclear localisation signal (NLS) can be found by multiple sequence alignment, followed by eye inspection, in the polypeptide sequences of Table A2. An NLS is one or more short sequences of positively charged lysines or arginines.

Computational prediction of protein localisation from sequence data was performed. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, TMpred, and others.

The PSort algorithm predicts a nuclear subcellular localization for a MYB91 polypeptide as represented by SEQ ID NO: 221, as highest probability (0.088). In addition, two putative NLS are predicted:

```
Found: pos:  81 (3) KK IAAEVPGRTA KRLGK
Found: pos: 273 (3) RR VELQLESERS CRRRE
```

Example 7

Assay Related to the Polypeptide Sequences Useful in Performing the Methods of the Invention 7.1. MYB91 Like Transcription Factor (MYB91)

MYB91 polypeptides useful in the methods of the present invention (at least in their native form) typically, but not necessarily, have transcriptional regulatory activity and capacity to interact with other proteins. DNA-binding activity and protein-protein interactions may readily be determined in vitro or in vivo using techniques well known in the art (for example in Current Protocols in Molecular Biology, Volumes 1 and 2, Ausubel et al. (1994), Current Protocols). MYB91 polypeptides contain two Myb DNA-binding domain (InterPro accession IPR014778).

7.2. Gibberellic Acid-Stimulated *Arabidopsis* (GASA)

Transgenic plants expressing GASA polypeptides (at least in their native form) may have enhanced tolerance to heat stress. A thermotolerance assay is described by Ko et al. (2007): to examine the heat stress test response in seed germination, seeds are sown on water-saturated filter paper. They are left to imbibe at room temperature for 18 h, transferred to 50° C., and subjected to 3 h of heat treatment. Thereafter they are transferred to 22° C. Cotyledon emergence is determined after 5 days. Experiments are done in triplicate for each line (30 seeds each). To assess heat tolerance assay, seeds are germinated on normal MS (Murashige & Skoog salt mixture) medium. Seven-day-old seedlings are exposed to 50° C. for 2.5 h, and the surviving plants are scored 10 days after returning to normal growth conditions. Experiments were done in triplicate for each line (40 seeds each). Wild type plants are used as controls.

7.3. IAA14 Polypeptides

IAA14 is reported to interact with ARF7 and ARF19 in a yeast two-hybrid system (Fukaki et al., 2005): The cDNA fragments encoding the C-terminus of *Arabidopsis* ARF5 (amino acids 778-902), ARF7 (amino acids 1031-1164) and ARF19 (amino acids 952-1086) are amplified from a flower cDNA library using the following primer sets: 5'-agaattcAATAGTAAAGGCTCATC ATGGCAG-3' and 5'-agtcgacGTTACATTTATGAAACAGAAGTCTTAAGATCG-3' for ARF5, 5'-agtcgacaAGCTCAGACTCAGCGAATGCG-3' and 5'-cagtcgacTCACCGGTTAAACGAA GTGGC-3' for ARF7, and 5'-gagaattcAATCAGACTCAACGAATGCG-3' and 5'-agtcgac CTATCTGTTGAAAGAAGCTGCAGC-3' for ARF19.

The full-length IAA14 open reading frame is amplified using two primers, 5'-cgaattcAT GAACCTTAAGGAGACGGAGC-3' and 5'-tgtcgacTCATGATCTGTTCTTGAACTTCTCC-3'. PCR products are subcloned into pCR-Blunt II TOPO (Invitrogen, Carlsbad, Calif., USA) and are sequenced before in-frame insertion into pAD-GAL4-2.1 or pBD-GAL4 Cam (Stratagene, Calif., USA) via EcoRI/SalI (IAA14, ARF5 and ARF19) or SalI (ARF7) sites. Constructs are next introduced into *Saccharomyces cerevisiae* Y190 cells, and transformants are subjected to assays for beta-galactosidase activity as previously described (Kaiser et al., Methods in Yeast Genetics: A Cold Spring Harbor Laboratory Course Manual. Cold Spring Harbor, N.Y.: Cold Spring Harbor Laboratory Press, 1994).

Example 8

Cloning of the Nucleic Acid Sequence Used in the Methods of the Invention 8.1. Aspartate AminoTransferase (ASPAT)

The nucleic acid sequence used in the methods of the invention was amplified by PCR using as template a custom-made cDNA library from either *Arabidopsis thaliana* seedlings or from *Oryza sativa* (in pCMV Sport 6.0; Invitrogen, Paisley, UK). PCR was performed using Hifi Taq DNA polymerase in standard conditions, using 200 ng of template in a 50 µl PCR mix. The cDNA library and primers used are given in Table F1.

TABLE F1

| ORF in SEQ ID NO: | cDNA library | Primer forward (sense) | Primer reverse (complementary) |
|---|---|---|---|
| SEQ ID NO: 3 | *Oryza sativa* | Ggggacaagttt gtacaaaaaagc aggcttaaacaa tggcgtcgtcgt cc | Ggggaccactt tgtacaagaaa gctgggtatgc taccatcattc acttca |
| SEQ ID NO: 5 | *Arabidopsis thaliana* | Ggggacaagttt gtacaaaaaagc aggcttaaacaa tggattccgtct tctctaac | Ggggaccactt tgtacaagaaa gctgggtaaaa atgtatggtcg ctagtt |
| SEQ ID NO: 7 | *Arabidopsis thaliana* | Ggggacaagttt gtacaaaaaagc aggcttaaacaa tgaaaactactc atttctcttc | Ggggaccactt tgtacaagaaa gctgggttggt gttcagtttct cagac |
| SEQ ID NO: 9 | *Arabidopsis thaliana* | Ggggacaagttt gtacaaaaaagc aggcttaaacaa tggcttctttaa tgttatct | Ggggaccactt tgtacaagaaa gctgggttgtc atctactgaga tggaag |

Primers include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pASPAT. Plasmid pDONR201 was purchased from Invitrogen, as part of the Gateway® technology.

The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 218) for constitutive specific expression was located upstream of this Gateway cassette.

Figure 3:
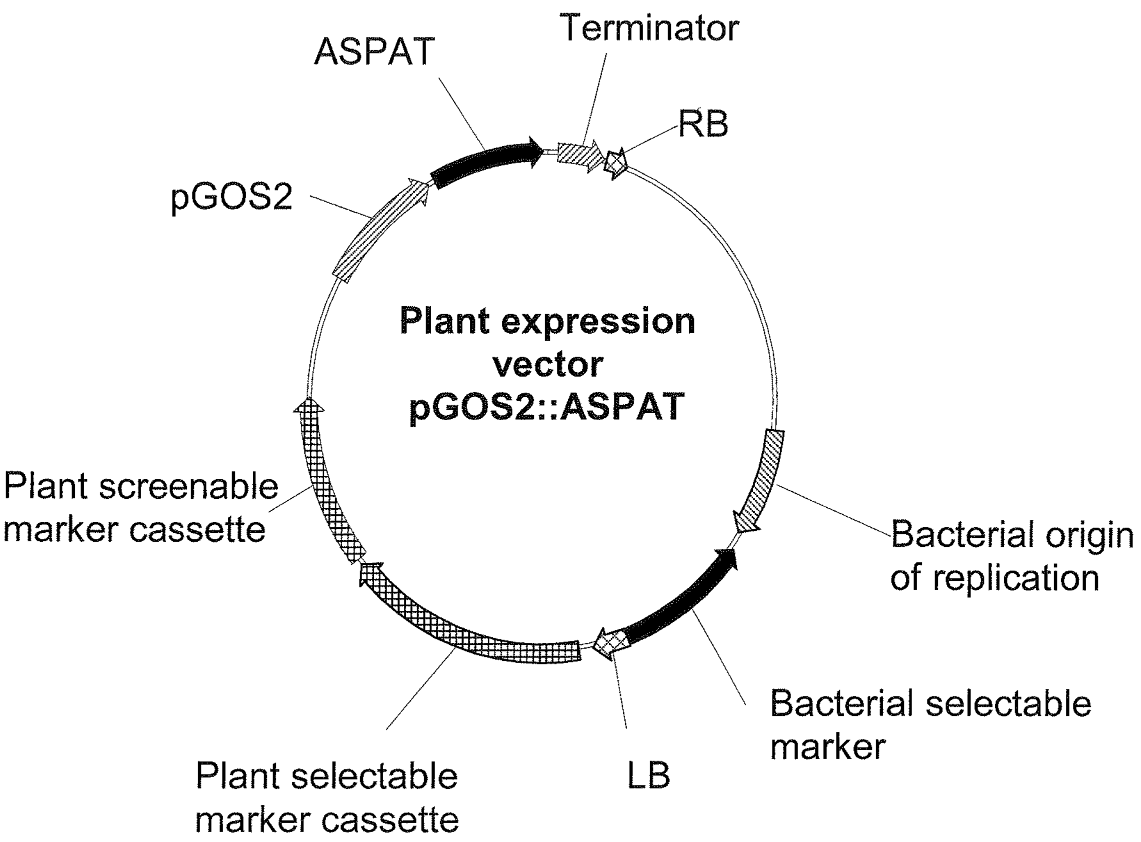
FIG. 3 represents the binary vector used for increased expression in *Oryza saliva* of an ASPAT-encoding nucleic acid under the control of a rice GOS2 promoter (pGOS2) or of a rice PR promoter.
Figure 4:
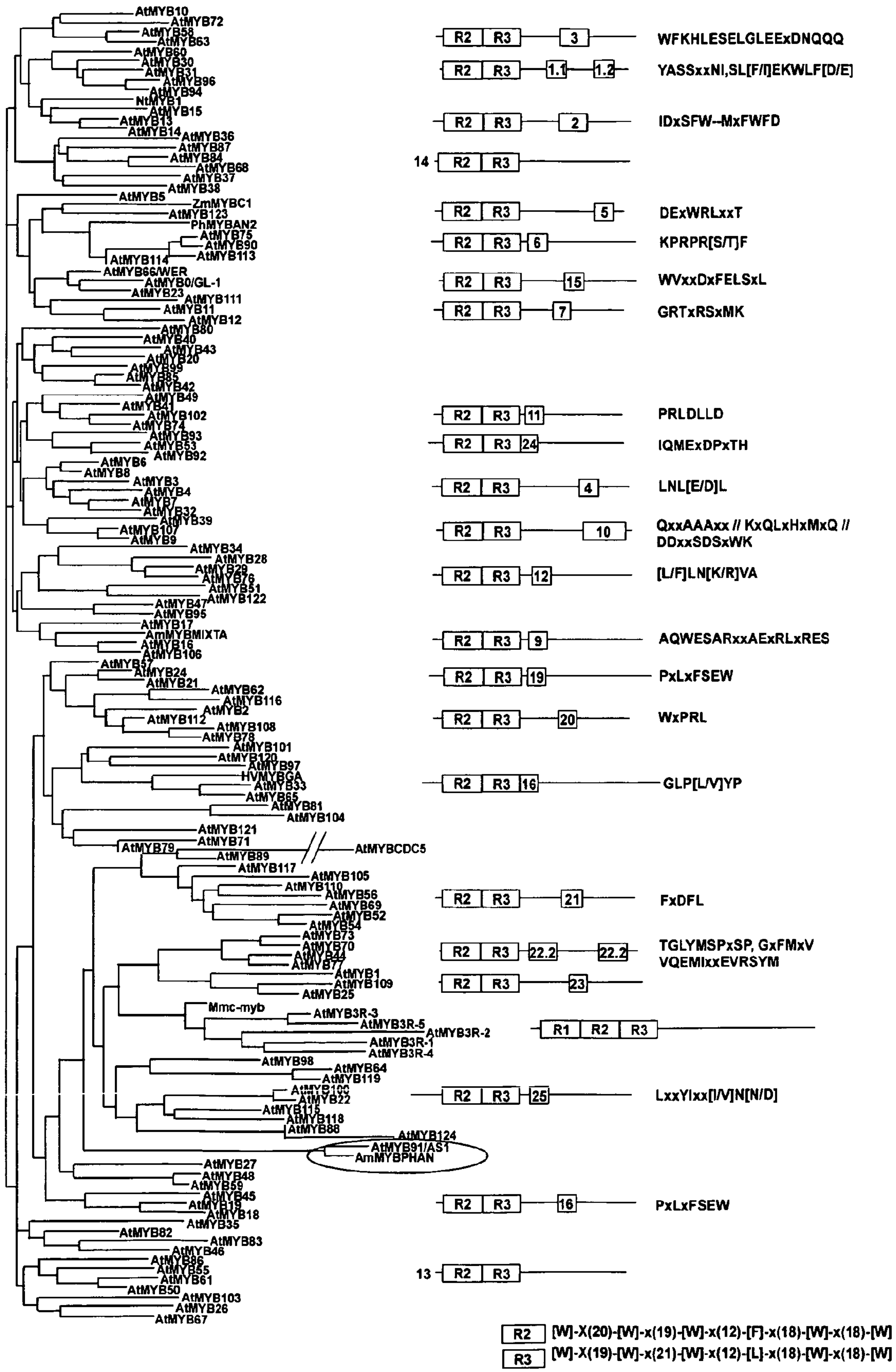
FIG. 4 represents the phylogenetic relationship among MYB DNA binding domain polypeptides from *Arabidopsis thaliana* and from other plants, based upon amino acid sequence (according to Stracke et al. (2004) Current Opinion in Plant Biology 2001, 4:447-456). The MYB polypeptides were clustered using PHYLIP, and motifs were detected using MEME. Polypeptides useful in performing the methods of the invention cluster with MYB91, circled and marked by a black arrow. Motifs shown are WFKHLESELGLEExDNQQQ (SEQ ID NO: 818); YASSxxNI SE ID NO: 819 SL[F/I]EK-WLF[D/E] (SEQ ID NO: 820); IDxSFW--MxFWFD (SEQ ID NO: 821); DExWRLxxT (SEQ ID NO: 822); KPRPR[S/T]F (SEQ ID NO: 823); WVxxpxFELSxL (SEQ ID NO: 824); GRTxRSxMK (SEQ ID NO: 825); PRLDLLD (SEQ ID NO: 826); IQMExDPxTH (SEQ ID NO: 827); LNL[E/D]L (SEQ ID NO: 828); QxxAAAxx (SEQ ID NO: 829); KxQLx-HxMxQ (SEQ ID NO: 830); DDxxSDSxWK (SEQ ID NO: 831); [L/F]LN[K/R]VA (SEQ ID NO: 832); AQWESARxx-AExRLxRES (SEQ ID NO: 833); PxLxFSEW (SEQ ID NO: 834); WxPRL (SEQ ID NO: 835); GLP[L/V]YP (SEQ ID NO: 836); FxDFL (SEQ ID NO: 837); TGLYMSPxSP (SEQ ID NO: 838); GxFMxV (SEQ ID NO: 839); VQEMIxx-EVRSYM (SEQ ID NO: 840); LxxYIxx[I/V]N[N/D] (SEQ ID NO: 841); PxLxFSEW (SEQ ID NO: 842); [W]-X(20)-[W]-x(19)-[W]-x(12)-[F]-x(18)-[W]-x(18)-[W] (SEQ ID NO: 843); and [W]-X(19)-[W]-x(21)-[W]x(12)-[L]-x(18)-[W]-x(18)-[W] (SEQ ID NO: 844).

After the LR recombination step, the resulting expression vector pGOS2::ASPAT (FIG. 3) was transformed into *Agrobacterium* strain LBA4044 according to methods well known in the art.

Similarly, expression vectors were generated comprising the following features (Table F2):

TABLE F2

| Vector | Promoter | ASPT nucleic acid (Longest ORF in SEQ ID NO:) |
|---|---|---|
| ExprVect1 | pPR (SEQ ID NO: 219) | SEQ ID NO: 3 |
| ExprVect2 | pGOS2 (SEQ ID NO: 218) | SEQ ID NO: 5 |
| ExprVect3 | pPR (SEQ ID NO: 219) | SEQ ID NO: 5 |
| ExprVect4 | pGOS2 (SEQ ID NO: 218) | SEQ ID NO: 7 |
| ExprVect5 | pGOS2 (SEQ ID NO: 218) | SEQ ID NO: 9 |

8.2. MYB91 Like Transcription Factor (MYB91)

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Populus trichocarpa* nucleic acid sequence encoding a MYB91 polypeptide sequence as represented by SEQ ID NO: 221 was amplified by PCR using as template a cDNA bank constructed using RNA from tomato plants at different developmental stages. The following primers, which include the AttB sites for Gateway recombination, were used for PCR amplification:

1) prm11884 (SEQ ID NO: 271, sense):
5'-GGGGACAAGTTTGTACAAAAAAGCAGGCTTAAACAATGAAGGAGA
GGCAGCGT-3'

2) prm11885 (SEQ ID NO: 272, reverse, complementary):
5'-GGGGACCACTTTGTACAAGAAAGCTGGGTGACCTGATACAGCTGG
ACGTA-3'

PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

The entry clone comprising SEQ ID NO: 220 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 53) for constitutive expression was located upstream of this Gateway cassette.

Figure 6:
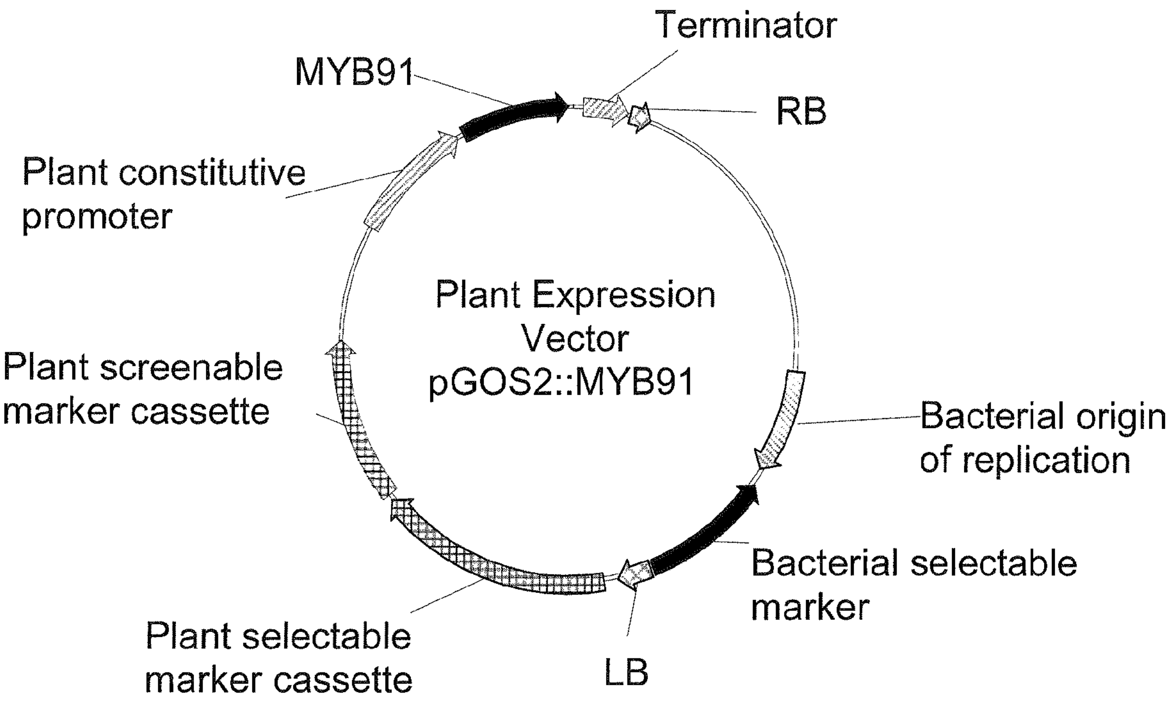
FIG. 6 shows the binary vector for increased expression in *Oryza sativa* plants of a nucleic acid sequence encoding a MYB91 polypeptide under the control of a promoter functioning in plants.

After the LR recombination step, the resulting expression vector pGOS2::MYB91 (FIG. 6) for constitutive expression, was transformed into *Agrobacterium* strain LBA4044 according to methods well known in the art.

8.3. Gibberellic Acid-Stimulated *Arabidopsis* (GASA)

a) Cloning of Tomato GASA:

The tomato nucleic acid sequence used in the methods of the invention was amplified by PCR using as template a custom-made *Solanum lycopersicum* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm10623 (SEQ ID NO: 286; sense, start codon in bold): 5'-ggggacaagtttgtacaaaaaagc aggcttaaacaatg-gagaagacacttagctta-3' and prm10624 (SEQ ID NO: 287; reverse, complementary): 5'-ggggaccactttgtacaagaaagctggg-tatatatgattaagggcatttt-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pGASA. Plasmid pDONR201 was purchased from Invitrogen, as part of the Gateway® technology.

The entry clone comprising SEQ ID NO: 275 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 290) for constitutive specific expression was located upstream of this Gateway cassette.

After the LR recombination step, the resulting expression vector pGOS2::GASA (FIG. 3) was transformed into *Agrobacterium* strain LBA4044 according to methods well known in the art.

b) Cloning of Poplar GASA

The poplar nucleic acid sequence used in the methods of the invention was amplified by PCR using as template a custom-made poplar seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm10625 (SEQ ID NO: 288; sense, start codon in bold): 5'-gggacaagtttgtacaaaaaagcaggctt aacaatgaagaagctcttctttgct-3' and prm10626 (SEQ ID NO: 289; reverse, complementary): 5'-ggggaccactttgtacaagaaagctggg-tacatgcacatcttgactgtct-3', which include the AttB sites for Gateway recombination. The amplified PCR fragment was purified also using standard methods, and the further cloning procedure was as described above, including use of the rice GOS2 promoter.

8.4. Auxin/Indoleacetic Acid Genes (AUX/IAA)

The nucleic acid sequence used in the methods of the invention was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix with a set of primer complementary to the first and last 20 nucleotides of SEQ ID NO: 431. The sequence of the forward primer used in the PCR can be represented by SEQ ID NO: 667 and the reverse primer by SEQ ID NO: 668. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", p AUX/IAA. Plasmid pDONR201 was purchased from Invitrogen, as part of the Gateway® technology.

The entry clone comprising SEQ ID NO: 431 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 669) for constitutive specific expression was located upstream of this Gateway cassette.

After the LR recombination step, the resulting expression vector pGOS2:: AUX/IAA (FIG. 12) was transformed into *Agrobacterium* strain LBA4044 according to methods well known in the art.

8.5. IAA14 Polypeptides

The nucleic acid sequence used in the methods of the invention was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm07273 (SEQ ID NO: 745; sense, start codon in bold): 5'-ggggacaagtttgtacaaaaaagcagg cttaaacaat-gaaccttaaggagacggag-3' and prm07274 (SEQ ID NO: 746; reverse, complementary): 5'-ggggaccactttgtacaa-gaaagctgggttcaatgcatattgtcctctttt-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pIAA14-like. Plasmid pDONR201 was purchased from Invitrogen, as part of the Gateway® technology.

The entry clone comprising SEQ ID NO: 737 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice HMGP promoter (SEQ ID NO: 747) for weak constitutive expression was located upstream of this Gateway cassette.

After the LR recombination step, the resulting expression vector pHMGP::IAA14-like (FIG. 16) was transformed into *Agrobacterium* strain LBA4044 according to methods well known in the art.

Example 9

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% HgCl$_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density (OD$_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M patent U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 10

Phenotypic Evaluation Procedure 10.1 Evaluation Setup

Approximately 35 independent T0 rice transformants were generated. The primary transformants were transferred from a tissue culture chamber to a greenhouse for growing and harvest of T1 seed. Events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions were watered at regular intervals to ensure that water and nutrients were not limiting and to satisfy plant needs to complete growth and development.

T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T2 seeds are grown in potting soil under normal conditions until they approached the heading stage. They are then transferred to a "dry" section where irrigation is withheld. Humidity probes are inserted in randomly chosen pots to monitor the soil water content (SWC). When SWC goes below certain thresholds, the plants are automatically re-watered continuously until a normal level is reached again. The plants are then re-transferred again to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

10.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention.

The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment—event—segregants). P values were obtained by comparing likelihood ratio test to chi square distributions.

10.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Examples 11

Results of the Phenotypic Evaluation of the Transgenic Plants

11.1. Aspartate AminoTransferase (ASPAT)

The results of the evaluation of transgenic rice plants in the T2 generation and expressing a nucleic acid comprising the longest Open Reading Frame in SEQ ID NO: 1 under the control of the rice GOS2 promoter in non-stress conditions are presented below (Table G1). See previous Examples for details on the generations of the transgenic plants. An increase of at least 5% was observed for aboveground biomass (AreaMax), emergence, seed yield (totalwgseeds), number of filled seeds (nrfilledseed), fill rate (fillrate), and plant height (HeightMax) (Table G1).

TABLE G1

Phenotype transgenic plants transformed with pGOS2::ASAPT.

| Parameter | % increase in transgenic plants versus control plants |
|---|---|
| AreaMax | 7.4 |
| totalwgseeds | 11.8 |
| nrfilledseed | 9.3 |
| fillrate | 5.0 |
| HeightMax | 5.0 |

The results of the evaluation of transgenic rice plants in the T1 generation and expressing a nucleic acid comprising the longest Open Reading Frame in SEQ ID NO: 5 under the control of the rice GOS2 promoter in non-stress conditions are presented below (Table G2). See previous Examples for details on the generations of the transgenic plants. An increase of at least 5% was observed for plant height (HeightMax).

TABLE G2

Phenotype transgenic plants transformed with ExprVect2.

| Parameter | % increase in transgenic plants versus control plants |
|---|---|
| Plant heigth | 5.2 |

The results of the evaluation of transgenic rice plants in the T1 generation and expressing a nucleic acid comprising the longest Open Reading Frame in SEQ ID NO: 5 under the control of the rice PR promoter in non-stress conditions are presented below (Table G3). See previous Examples for details on the generations of the transgenic plants. An increase of at least 5% was observed for aboveground biomass (AreaMax), emergence vigour (EmerVigor), seed yield (totalwgseeds), number of filled seeds (nrfilledseed), number of flowers per panicle (flowerperpan), number of first panicle (firstpan), total number of seeds (nrtotalseed) and plant height (HeightMax).

TABLE G3

Phenotype transgenic plants transformed with the expression vector ExprVect3.

| Parameter | % increase in transgenic plants versus control plants |
|---|---|
| AreaMax | 29.3 |
| EmerVigor | 49.8 |
| totalwgseeds | 31.2 |
| nrfilledseed | 32.0 |
| flowerperpan | 9.5 |
| firstpan | 15.8 |
| nrtotalseed | 26.8 |
| HeightMax | 11.6 |

The results of the evaluation of transgenic rice plants in the T2 generation and expressing a nucleic acid comprising the longest Open Reading Frame in SEQ ID NO: 5 under the control of the rice PR promoter in non-stress conditions are presented below (Table G4). See previous Examples for details on the generations of the transgenic plants. An increase of at least 5% was observed for aboveground biomass (AreaMax), emergence vigour (EmerVigor), total seed yield (totalwgseeds), number of filled seeds (nrfilledseed), nr of flowers per panicle (flowerperpan), number of first panicle (firstpan), total number of seeds (nrtotalseed) and plant height (HeightMax).

TABLE G4

Phenotype transgenic plants transformed with the expression vector ExprVect3.

| Parameter | % increase in transgenic plants versus control plants |
|---|---|
| AreaMax | 9.7 |
| EmerVigor | 17.8 |
| totalwgseeds | 24.4 |
| nrfilledseed | 23.3 |
| fillrate | 8.4 |
| harvestindex | 14.7 |
| firstpan | 10.8 |
| nrtotalseed | 14.9 |
| HeightMax | 5.3 |

The results of the evaluation of transgenic rice plants in the T1 generation and expressing a nucleic acid comprising the longest Open Reading Frame in SEQ ID NO: 3 under the control of the rice PR promoter in non-stress conditions are presented below (Table G5). See previous Examples for details on the generations of the transgenic plants. An increase of at least 5% was observed for seed yield (totalwgseeds), number of filled seeds (nrfilledseed), harvest index (harvestindex), and seed filling rate (fillrate).

TABLE G5

| Phenotype transgenic plants transformed with the expression vector ExprVect1. | |
|---|---|
| Parameter | % increase in transgenic plants versus control plants |
| totalwgseeds | 23.0 |
| nrfilledseed | 20.1 |
| fillrate | 9.9 |
| harvestindex | 13.8 |

The results of the evaluation of transgenic rice plants in the T1 generation and expressing a nucleic acid comprising the longest Open Reading Frame in SEQ ID NO: 9 under the control of the rice GOS2 promoter in non-stress conditions are presented below (Table G6). See previous Examples for details on the generations of the transgenic plants. An increase of at least 5% was observed for filled seeds (nrfilledseed) and harvest index (harvestindex).

TABLE G6

| Phenotype transgenic plants transformed with the expression vector ExprVect5. | |
|---|---|
| Parameter | % increase in transgenic plants versus control plants |
| fillrate | 6.6 |
| harvestindex | 6.0 |

The results of the evaluation of transgenic rice plants under non-stress conditions are presented below. An increase of at least 5% was observed for fill rate and harvest index.

11.2. MYB91 Like Transcription Factor (MYB91)

The results of the evaluation of T1 generation transgenic rice plants expressing the nucleic acid sequence encoding a MYB91 polypeptide as represented by SEQ ID NO: 221, under the control of a constitutive promoter, and grown under normal growth conditions, are presented below.

There was a significant increase in plant height, in harvest index (HI), and in Thousand Kernel Weight (TKW).

TABLE G7

| Results of the evaluation of T1 generation transgenic rice plants expressing the nucleic acid sequence encoding a MYB91 polypeptide as represented by SEQ ID NO: 221, under the control of a promoter for constitutive expression. | |
|---|---|
| Trait | 0verall average % increase in 4 events in the T2 generation |
| Plant height | 3% |
| Harvest index | 8% |
| Thousand kernel weight | 6% |

11.3. Gibberellic Acid-Stimulated *Arabidopsis* (GASA)

The results of the evaluation of transgenic rice plants expressing the tomato GASA nucleic acid under control of a medium strength constitutive promoter under non-stress conditions are presented below in Table G8.

TABLE G8

| overall increase (%) for yield parameters | | |
|---|---|---|
| parameter | 1st evaluation | 2nd evaluation |
| Time to flower | 2.1 | 3.5 |
| Fill rate | 10.4 | 8.3 |
| Flowers per panicle | 4.8 | 14.7 |

The flowering time was reduced compared to control plants, and there was an increase of more than 5% for fill rate and for the number of flowers per panicle.

The results of the evaluation of transgenic rice plants expressing the poplar GASA nucleic acid under control of a medium strength constitutive promoter under non-stress conditions are presented below in Table G9.

TABLE G9

| overall increase (%) for yield parameters | | |
|---|---|---|
| parameter | 1st evaluation | 2nd evaluation |
| Total weight of seeds | 13.3 | 13.7 |
| Harvest index | 18.8 | 22.2 |
| Thousand Kernel weight | 4.2 | 2.9 |

11.4. Auxin/Indoleacetic Acid Genes (AUX/IAA)

The results of the evaluation of transgenic rice plants in the T2 generation and expressing a nucleic acid comprising the longest Open Reading Frame in SEQ ID NO: 431 under non-stress conditions are presented below. See previous Examples for details on the generations of the transgenic plants.

The results of the evaluation of transgenic rice plants under non-stress conditions are presented below (Table G10). An increase of at least 5% was observed for the number of filled seed per plant (nrfilledseed), harvest index (harvestindex) and seed yield (totalwgseeds.

TABLE G10

| Yield-related trait | Percentage increase in transgenic plants compared to control plants |
|---|---|
| totalwgseeds | 12.0 |
| harvestindex | 8.3 |
| nrfilledseed | 11.2 |

11.5. IAA14 Polypeptides

The results of the evaluation of T2 transgenic rice plants expressing the IAA14-like nucleic acid of SEQ ID NO: 738 under non-stress conditions are presented below (Table G11).

TABLE G11

| Overall yield increase (in %) of transgenic plants expressing SEQ ID NO: 738 | |
|---|---|
| Parameter | Overall increase |
| totalwgseeds | 19.2 |
| nrfilledseed | 18.6 |
| fillrate | 18.8 |
| harvestindex | 21.1 |
| HeightMax | 5.5 |
| GravityYMax | 6.6 |

An increase was found for total weight of seeds, the number of filled seeds, for the fill rate (number of filled seeds divided by the total number of seeds and multiplied by 100), harvest index, height of the plant and the gravity center (indication of branching of plants). For each of the parameters listed in Table G11, the p-value was $p<0.05$.

SEQUENCE LISTING (844 sequences)

SEQ ID NO: 1 - DNA, 1888 bp, Oryza sativa
acggcaccaccatcgaacaaagaatagcgcgcacgcattcgcctcgacgccgcatactcgcgtccacgagccccgcgagaaacagctatccacgtcatccgcggcggccgcccgccgttttcccttttccaggcgcgactcggcggccgcacccggttgcgcacgccgctccccccccccccccccccccacgccacgctcccccgcctcgtttcccccgcgcggccgcgccagaaaggggagaaacgcttcacgcgcgcggcgcaccctagcttgggccacgatgccatccgctaacgtgcgcggggcgcagcctagcgccgaccgcaggttaagtacgctggtgcgccacctactgccttcctccgcacgaacagcaaccaccaccagcacctcctcctccgccgccgacgccgactcctccctccaagctttccccaccatggcgtcgtcgtccgtcttcgctggcctcgcgcaggcgccggaggaccccatcctcggggtgacggtcgcgtacaacaaggatcccagccccgtgaaggtcaatctcggcgtcggcgcctaccggaccgaggaagggaagcccctggtgctgaatgtggtcaggcgcgctgagcagatgctgatcaacaacccgtcacgtgttaaggagtatttgccgatcactggactggccgatttcaataagctgagtgctaagcttatttttggtgctgacagtcctgccattcaagagaatagggtggctacagttcagtgcttgtcaggaactggttctttaagggtgggaggtgaatttcttgcaaggcattatcatgaacgcactatatacatcccacagccaacctgggggaatcaccccaaagtgttcactttagctggcctgactgttaggagttaccgctactatgatcctgcaacccgtggactggatttccaagggctgttagaagatctcggttcagctccttcaggtgcaattgtactgcttcatgcttgtgcccacaaccctactggagtagacccaactttggaccagtgggaacagatcaggcagttgatgagatcaaaagcattgctgccattctttgatagcgcttatcagggatttgcaagtggaagtcttgaccaagatgctcaatcagtgcgcatgtttgttgctgatggtggtgaattgctcatggctcagagctacgctaagaacatgggattgtatggagagcgtgtcggtgctttaagcatagtttgtggaagtgctgatgtagctgtcagggttgaaagtcaacttaagcttgtaattaggcctatgtattcaaaccctcctattcatggtgcatctatcgtggctaccatacttaaggacagtgcaatgttcaatgaatggactgtggagctgaagggcatggctgataggattattagcatgaggcaacagctttttgatgctctgaaaacgagagaaactcctggagactggagtcacatcattaagcagatcggaatgttcactttcactgggctcaacagtgatcaagtggctttcatgaggcaggaataccacatttacatgacatctgatgggaggatcagtatggctggtttgagcgggaggaccattccgcatcttgcagatgcaatccatgccgcagtcacaaaactgaagtgaatgatggtagcatagcagctccctccaagaataacatcttaaaaccatccgcagcagtgttctgaggattcagacagtgatgtttgctggctgagcacatcctggaagtttccttgtaatagactcgtgtgacttgcttttgggagcagttttgtaccagtggattcagaaaaagtggtgatttcgaatcacctaataagctccatcggtgatgcttttacc

SEQ ID NO: 2 - protein, 460 aa, Oryza sativa
MPSANVRGAQPSADRRLSTLVRHLLPSSARTATTTSTSSSAADADSSLQAFPTMASSSVFAGLAQAPEDPILGVTVAYNKDPSPVKVNLGVGAYRTEEGKPLVLNVVRRAEQMLINNPSRVKEYLPITGLADFNKLSAKLIFGADSPAIQENRVATVQCLSGTGSLRVGGEFLARHYHERTIYIPQPTWGNHPKVFTLAGLTVRSYRYYDPATRGLDFQGLLEDLGSAPSGAIVLLHACAHNPTGVDPTLDQWEQIRQLMRSKALLPFFDSAYQGFASGSLDQDAQSVRMFVADGGELLMAQSYAKNMGLYGERVGALSIVCGSADVAVRVESQLKLVIRPMYSNPPIHGASIVATILKDSAMFNEWTVELKGMADRIISMRQQLFDALKTRETPGDWSHIIKQIGMFTFTGLNSDQVAFMRQEYHIYMTSDGRISMAGLSGRTIPHLADAIHAAVTKLK

SEQ ID NO: 3 - DNA, 1334 bp, Oryza sativa
tgactgttcgttgcacaaattgatgagcaatgcttttttataatgccaactttgtacaaaaaagcaggcttaaacaatggcgtcgtcgtccgtcttcgctggcctcgcgcaggcgccggaggaccccatcctcggggtgacggtcgcgtacaacaaggatcccagccccgtgaaggtcaatctcggcgtcggcgcctaccggaccgaggaagggaagcccctggtgctgaatgtggtcaggcgcgctgagcagatgctgatcaacaacccgtcacgtgttaaggagtatttgccgatcactggactggccgatttcaataagctgagtgctaagcttatttttggtgctgacagtcctgccattcaagagaatagggtggctacagttcagtgcttgtcaggaactggttctttaagggtgggaggtgaatttcttgcaaggcattatcatgaacgcactatatacatcccacagccaacctgggggaatcaccccaaagtgttcactttagctggcctgactgttaggagttaccgctactatgatcctgcaacccgtggactggatttccaagggctgttagaagatctcggttcagctccttcaggtgcaattgtactgcttcatgcttgtgcccacaaccctactggagtagacccaactttggaccagtgggaacagatcaggtagttgatgagatcaaaagcattgctgccattctttgatagcgcttatcagggatttgcaagtggaagccttgaccaagatgctcaatcagtgcgcatgtttgttgctgatggtggtgaattgctcatggctcagagctacgctaagaacatgggattgtatggagagcgtgtcggtgctttaagcatagtttgtggaagtgctgatgtagctgtcagggttgaaagtcaacttaagcttgtaattaggcctatgtattcaaaccctcctattcatggtgcatctatcgtggctaccatacttaaggacagtgcaatgttcaatgaatggactgtggagctgaagggcatggctgataggattattagcatgaggcaacagctttttgatgctctgaaaacgagagaaactcctggagactggagtcacatcattaagcagatcggaatgttcactttcactgggctcaacagtgatcaagtggctttcatgaggcaggaataccacatttacatgacatctgatgggaggatcagtatggctggtttgagcgggaggaccattccgcatcttgcagatgcaatccatgccgcagtcacaaaactgaagtgaatgatggtagcatacccagctttcttgtacaaag

SEQ ID NO: 4 - protein, 204 aa, Oryza sativa
MASSSVFAGLAQAPEDPILGVTVAYNKDPSPVKVNLGVGAYRTEEGKPLVLNVVRRAEQMLINNPSRVKEYLPITGLADFNKLSAKLIFGADSPAIQENRVATVQCLSGTGSLRVGGEFLARHYHERTIYIPQPTWGNHPKVFTLAGLTVRSYRYYDPATRGLDFQGLLEDLGSAPSGAIVLLHACAHNPTGVDPTLDQWEQIR

SEQ ID NO: 5 - DNA, 1218 bp, Arabidsopsis thaliana
atggattccgtcttctctaacgttgctcgtgctcccgaagatcctattctcggtgtaactgttgcttacaacaatgatcctagtcctgttaagatcaatttgggtgtcggtgcctaccgaactgaggaagggaagcctcttgttcttgatgtggtgcgtaaggcagagcaacagctagtgaacgatccgtctcgggtcaaggaatacattcccattgttggtatttccgattttaacaagttaagcgccaagctcatcttaggtgctgacagtcctgcgattacagaaagtagagttactacagtccagtgcttgtctggtactggttcgttgagagttggggctgagtttctcaaaacacactaccaccaaagtgtcatttacattccaaaaccaacttgggggaaccatcccaaagttttcaacttggcaggcttgtctgtggagtatttccgctactatgatcctgcaacccgtggtcttgacttcaaaggcttgctcgaggatcttggcgctgcaccatctggagctattgtcttacttcatgcatgtgcacacaatcccactggagttgacccaacctctgaacagtgggaacagattcgacagctgatgagatctaaaagcttattacccttttttgatagtgcatatcagggttttgctagtggtagccttgacacagatgcacaatctgtccgtacatttgttgctgatggcggtgaatgcttgatagctcaaagttacgccaaaaatatgggactttatggggagcgtgttggtgcccttagcattgtctgcaagtcagcagatgtggctagtaaggttgagagccaggtgaagcttgttgtgcggcccatgtattcgagcccccctattcatggagcatcaattgttgccaccattctaaaaagcagtgatatgtacaacaactggaccatcgagctgaaagaaatggctgaccgtataaagagcatgcgccaacagttatttgaagctatacaagctagaggtacacctggtgactggagtcatattatcaaacagattgggatgtttacatttactggattgaacaaggagcaagttgaattcatgaccaaagagttccacatttacatgacctctgatgggagaataagcatggcaggtctaagttcgaagacagtgcctcaccttgccgatgctatgcatgctgcagtgacccgcctcggctaa

SEQ ID NO: 6 - protein, 405 aa, Arabidsopsis thaliana
MDSVFSNVARAPEDPILGVTVAYNNDPSPVKINLGVGAYRTEEGKPLVLDVVRKAEQQLVNDPSRVKEYIPIVGISDFNKLSAKLILGADSPAITESRVTTVQCLSGTGSLRVGAEFLKTHYHQSVIYIPKPTWGNHPKVFNLAGLSVEYFRYYDPATRGLDFKGLLEDLGAAPSGAIVLLHACAHNPTGVDPTSEQWEQIRQLMRSKSLLPFFDSAYQGFASGSLDTDAQSVRTFVADGGECLIAQSYAKNMGLYGERVGALSIVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 7 - DNA, 1561 bp, Arabidsopsis thaliana
atttcttcattcgtaaacaaacacacacgaagcaaaaacaaaaatgaaaactactcatttctcttcctcttcttcttccgatcgcaggatcggtgctctgctccgtcatctcaattccggctcagattcggacaacctgagctctctttatgcatctccgacatcgggaggcaccggtggttctgttttctctcatcttgttcaagctccagaggatcctattcttggggtgacagttgcatacaacaaagatcctagcccagttaagctgaatttaggagttggtgcttaccgaactgaggagggaaaacctttggttcttaatgttgtgaggaaagctgagcagcagcttatcaatgacagaacaagaatcaaggagtatcttcccattgttggattggttgagttcaacaagttaagcgctaagctcatactaggcgctgacagtcctgctattcgggagaatcggattaccaccgtggagtgtttgtctggtactggttctctgagagttggaggagagtttttggctaaacattatcatcagaaaacaatttacatcactcagccaacatggggaaatcatccaaagattttcacgctcgctggtttgacagtgaaaacttaccgatactacgatccagcgacgcgtgggttgaactttcaaggtttattagaagaccttggtgctgccgcacctggttctatagtgcttctccatgcctgtgcccataaccctactggtgttgatccaaccattcaacaatgggagcaaatcaggaagttgatgcgatcaaagggattgatgcccttcttcgatagtgcttatcagggctttgcaagtggaagtcttgatacagatgcgaaacctattaggatgtttgttgctgatggcggagaatgcctcgttgctcaaagttatgcgaagaacatgggactctatggagaacgagttggagctctcagcattgtatgcaaatcagcagatgttgcggggagagttgaaagccaactgaaactagtgataaggccaatgtactcgagtcctccaatccatggtgcatcaatcgtggctgtaatcctccgtgacaagaatttgttcaacgaatggactctggaactgaaggccatggctgatcgtatcatcagcatgaggaaacagcttttcgaggcattacgtactcgaggcactcctggagactggagtcacatcataaagcagattggtatgtttaccttcacagggttaaacccagctcaagtctccttcatgactaaagagtaccacatctacatgacatctgacgggaggataagcatggctggtctgagttcgaagactgtacctcaccttgcagacgctatccatgctgttgtcaccaaagccgtctgagaaactgaacaccaccatgacaccaaagcttcataataaagattttgttcttttctttctattatagcatttccggcagtgacaagataaatgtcgttactattattattgtttcatcccagtatcaataaagtacgcaagaaagcttttgtgctctctcttctacta

SEQ ID NO: 8 - protein, 449 aa, Arabidsopsis thaliana
MKTTHFSSSSSSDRRIGALLRHLNSGSDSDNLSSLYASPTSGGTGGSVFSHLVQAPEDPILGVTVAYNKDPSPVKLNLGVGAYRTEEGKPLVLNVVRKAEQQLINDRTRIKEYLPIVGLVEFNKLSAKLILGADSPAIRENRITTVECLSGTGSLRVGGEFLAKHYHQKTIYITQPTWGNHPKIFTLAGLTVKTYRYYDPATRGLNFQGLLEDLGAAAPGSIVLLHACAHNPTGVDPTIQQWEQIRKLMRSKGLMPFFDSAYQGFASGSLDTDAKPIRMFVADGGECLVAQSYAKNMGLYGERVGALSIVCKSADVAGRVESQLKLVIRPMYSSPPIHGASIVAVILRDKNLFNEWTLELKAMADRIISMRKQLFEALRTRGTPGDWSHIIKQIGMFTFTGLNPAQVSFMTKEYHIYMTSDGRISMAGLSSKTVPHLADAIHAVVTKAV

SEQ ID NO: 9 - DNA, 1849 bp, Arabidsopsis thaliana
ttgaatccttgttaatctttttcttcaatctctcgatctgatcgttatcgaaaccgcgcgattctaaccaagtccaggtgacaaatcagctctgctaaaatactcacaaagtctcgtgatcatattttgtggatcacatcattgtcttatttttggaattgcttatcctcgcactagttcactgatttgagatctgtgcagttaattttgtgctccatagcgattccatggcttctttaatgttatctctcggttccacttctctgttaccgcgcgagattaacaaggataagctaaagcttggaacttctgcttcgaacccgttcctaaaagcaaagtcttttagcagagtgactatgacggttgcagtgaagccttctcgtttcgagggtataactatggctccaccagaccctattcttggagtcagtgaagcattcaaagctgacactaacgggatgaaactcaatcttggtgttggtgcttatcgtactgaggaactccagccttatgtgcttaatgttgttaaaaaggcggagaatttgatgttggagagaggagataacaaagagtatcttccaattgaggggttggcagcattcaacaaggctactgctgagttgctatttggagctggtcatcctgttattaaggaacaaagagtagcaacaattcagggtctttcgggaacaggttcactgcgattagcagcggctcttatagagcgttatttccctggagcaaaagttgtgatctcatcaccaacctggggtaatcacaagaatatcttcaatgatgccaaagttccgtggtccgaataccgctactatgatccaaaaacaattggtttggattttgagggaatgatagcagatataaaggaagctccagaaggatccttcatcttgcttcacggatgtgctcacaacccaactggaattgacccaacaccagaacagtgggtaaaaattgctgatgtcattcaggaaaagaaccatatcccatttttcgatgttgcataccagggctttgctagtggaagccttgatgaagatgcagcatctgtgagattatttgctgagcggggaatggagttttttgttgctcagtcatatagtaaaaatttaggtttgtatgcagaaagaattggggcaatcaatgtcgtgtgctcctcagctgatgctgctacaagggtcaagagccagttgaaaaggattgctcggcctatgtactcgaatccaccagttcatggggcgagaatcgtggccaatgtagtgggtgatgtaactatgttcagtgaatggaaagcagagatggaaatgatggcaggaagaataaagacggttagacaagagctgtatgatagcctcgtttcaaaagacaagagcgggaaggactggtccttcattctgaagcaaattggcatgttctctttcaccggcctaaacaaagctcagagcgataacatgacggacaaatggcatgtgtatatgactaaagacgggaggatatcattggccggattatctctggccaaatgcgagtatcttgctgatgcgatcatcgactcataccataacgtaagctgagcttccatctcagtagatgacaataagaaacagttttatataccctttttagcttcttcttgatctttgattgaaaccagatggctaaattaataagctagcatcacactatgattgctagacaattttcaaggaaacttttgatttgatcgtgtttgacaggccttgttgtattgggagactcccatcgagttatagaagaacttgttacgattgtattttacataatttcacaactatacttgaccggaagagttaca

SEQ ID NO: 10 - protein, 453 aa, Arabidsopsis thaliana
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNVS

SEQ ID NO: 11 - DNA, 1212 bp, Arabidsopsis thaliana
atgaattccatcttgtcaagcgtccttcctgctcccgaagatcctgttctcagtgtaatttttgcttgtagagatgatcctagtccggttaagttgaatttgagcgcaggtacctatcgaactgaggaaggaaagcctcttgttcttgatgttgtgagaagagcagagcaacagttagccaacgacctggacaaggaatatcttcccctcaatggacttcctgaatttaataaattaagtaccaagctcatcttaggtgatgatagtcctgcattgaaagagaatagagttgttacaacccaatgtttgtctggtactggttctttgagagttggagctgagtttctagcaacacacaacaaagaaagtgtcattttcgttccaaacccaacgtgggggaaccatccccgtatttttactttggcgggtttgtctgtccagtatttccgttattatgatccgaagagccgaggactcgacttcaaaggcatgctcgaggatcttggcgctgcacctcctggagctatagtggtacttcaagcttgtgcgcataaccccacaggagttgacccaacattcgaacaatgggaaaagattcgacgactagtgagatcgaaaagcttattacctttctttgatagtgcatatcagggttttgctagtggtagccttgacgcagatgcacaagcggttcgtatgtttgtagccgatggaggtgaatgtttgatagctcaaagttatgccaaaaatatgggcctttatggggagcgtattggctctcttacgatcgtatgcacatcagaagatgtcgctaagaaagttgagaaccaagtgctacttgttgtgaggcctatgtatcttacaccacctattcatggtgcatctattgttgccacaattctaaaaaacagtgatatgtacaatgactggaccattgagctgaaaggaatggctgaccgcataattagcatgcgtcaacagttatatgcagctctagaagctagaggaacacctggtgattggagtcacattattaaacatattgggatgtttacttttaccggattgagtgaggagcaagttcgcttgatggccaaagaatatcacatttacatgacttatgatgggaggataagcatggcaagtctaagttcgaagacagtgcctcaactcgctgatgctatacatgctgttgttactcgcatcgcctaa

SEQ ID NO: 12 - protein, 403 aa, Arabidsopsis thaliana
MNSILSSVLPAPEDPVLSVIFACRDDPSPVKLNLSAGTYRTEEGKPLVLDVVRRAEQQLANDLDKEYLPLNGLPEFNKLSTKLILGDDSPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSKTVPQLADAIHAVVTRIA

SEQ ID NO: 13 - DNA, 1603 bp, Brassica napus
ggtattcatacacacaaatcgaaaaacaatgaaaactaacgacttctcttcttcatcttcgtcgtcgccaagcgatcgcaggatcggcgctctcctccgtcatctcaccgccgggacagatgcggatcgcgtgagctccgttttcgcttcgcctacgtcgggaggcgcgggaggttctgttttcgctcatctcgttcaagctcccgaggatgctattctcggggtgacaattgcatataacaaggaccccagcccaattaagcttaatttgggagttggtgcttaccgaactgaggaggggaaacctttggttcttaatgttgtgaggaaagctgagcagcagcttatcaatgacaggtcacggatcaaggagtatcttcccattgttggattggttgagttcaacaagttaagcgctaagctcattttaggcgctgacagtcctgctattcgggagaatcgtgttacaaccgtggagtgtttgtctggtactggttccctgagagttggtggggaatttttggctaggcattatcatcagaaaacaatttatattcctcagccaacatggggaaaccatcccaaaattttcaccctcgctggcttgtcagtgaaaacttaccgctactatgatccatcaacacgtgggttgaactttcaaggtttattagaagaccttagtgctgccccacagggttcgatagtgcttctccatgcctgtgctcataacccaactggtgttgatccaacccttgaacaatgggagcaaatcaggaagttgatgcgttccaaaggattgatgccattctttgacagtgcttatcagggctttgcgagtggaagtctggatacagatgcgaaaccaattaggatgtttgttgctgatggaggagaattgctcgttgctcagagttatgcaaagaacatgggactctatggagaacgtgttggagctctcagcattgtatgcaaagcagcagatgtagcgggaagagttgagagccaactgaaacttgtaataaggccaatgtactcaaaccctccgatccatggtgcatccatcgttgctgtaatcctccgtgacaggaacttgttcaacgaatggactctggaactgaaagccatggctgatcgtatcatcagcatgaggaaacagcttttcgaggcattacgtgctcgaggcacgcctggagactggactcacatcatcaaacagatcggtatgtttaccttcacagggctaaacccagctcaagtctcctacatgactaaagagtaccacatctacatgacatccgacgggaggataagtatggctggtctgagctcgaagactgtaccgcaccttgcagacgctatccatgccgttgtcaccaaagccctctgagacatctcacaccaccaccacggttacatggtgataataaagaatcttaccttctttcagtatttccggcagtgacaagttaattgtcactaatattattgttatttcatctcaggggttaataaagtaggcaagagagttttgtgcctcttctactatttacattctcaatgtaactttgtagacagcaaccaattttcaatttttggttctatc

SEQ ID NO: 14 - protein, 452 aa, Brassica napus
MKTNDFSSSSSSSPSDRRIGALLRHLTAGTDADRVSSVFASPTSGGAGGSVFAHLVQAPEDAILGVTIAYNKDPSPIKLNLGVGAYRTEEGKPLVLNVVRKAEQQLINDRSRIKEYLPIVGLVEFNKLSAKLILGADSPAIRENRVTTVECLSGTGSLRVGGEFLARHYHQKTIYIPQPTWGNHPKIFTLAGLSVKTYRYYDPSTRGLNFQGLLEDLSAAPQGSIVLLHACAHNPTGVDPTLEQWEQIRKLMRSKGLMPFFDSAYQGFASGSLDTDAKPIRMFVADGGELLVAQSYAKNMGLYGERVGALSIVCKAADVAGRVESQLKLVIRPMYSNPPIHGASIVAVILRDRNLFNEWTLELKAMADRIISMRKQLFEALRARGTPGDWTHIIKQIGMFTFTGLNPAQVSYMTKEYHIYMTSDGRISMAGLSSKTVPHLADAIHAVVTKAL

SEQ ID NO: 15 - DNA, 1504 bp, Brassica napus
  misc_feature (1444)..(1444): n is a, c, g, or t
ggaggaaaaaaggcaatcgacgctaataaactctcttcatccagattcatcttttttacgatacctgctgtaatggactccgtattctcaaacgtcgttcgtgctcccgaagatcctattctcggtgtgacggttgcttacaacaatgatccaagcccagctaagctcaatttgggtgtcggtgcctatcgaactgaggaaggtaagccacttgttcttgacgtggttcgaagggcagagcaacagcttgtgaacgatccgtcccgggtcaaggaatatattcctatggctggacttgctgattttaataaactcagcgccaaactcatcttaggtgctgatagtcctgcaattcaagagagtagagttgctacaatccagtgcttgactggtactggttctttgagagttggtgctgagtttctcaaaaaacactaccaccaaagtgtcattttcattccaaaaccaacttgggggaaccatcccaaagttttcaacctggctggcttgtctgtggagtactaccgttactatgatcctgcaacccgtggacttggcttccacggcttgctcgaggatctgggcgctgcaccatctggagcgattgtcttacttcatgcatgtgctcacaatcccactggagttgacccaacctccgaacagtgggaacagattcggcaactaataagatctaaaagcttgttaccgttttttgatagtgcatatcagggttttgctagtggtagccttgacacagatgcacattcagtccgcacctttgttgctgatggcggtgaatgcttgatagctcaaagttatgccaaaaatatgggactctatggggagcgtgttggtgcccttagcattgtctgcaagtcatcagatgtggctagtaaggttgagagccaggtgaaacttgttgtgcgacccatgtactcgagcccacctattcatggagcatcaattgttgccaccattctgaaaagcagtgatatgtacaacgactggaccatcgagctgaaaggaatggctgaccgcattattagcatgcgccaacacttatttgaagctctacaagctaaaggcacacctggtgattggagtcacattatcaaacagattgggatgttcacttttactggattgaacaaggagcaagttgccttcatgaccaaagagtttcacatttacatgacatctgacgggagaataagcatggcaggtctcagttcgaagacggtgcctcacctggttgaagctatacatgctgcagttacccgcgtcgcctaaactaaagcgagacgatatttttcttgtttcgtagaataaaatgaaattttcaaaaacaaaaaaaaaacatcttccttggtttatagactaaggatttttcccattggtatcatatgtttcctcatatctttttggccaaggatgtttgaaccanacaaaccgagtattgcgacactgaaatcttcaatgttgaaggaaaatattggttattagc

SEQ ID NO: 16 - protein, 405 aa, Brassica napus
MDSVFSNVVRAPEDPILGVTVAYNNDPSPAKLNLGVGAYRTEEGKPLVLDVVRRAEQQLVNDPSRVKEYIPMAGLADFNKLSAKLILGADSPAIQESRVATIQCLTGTGSLRVGAEFLKKHYHQSVIFIPKPTWGNHPKVFNLAGLSVEYYRYYDPATRGLGFHGLLEDLGAAPSGAIVLLHACAHNPTGVDPTSEQWEQIRQLIRSKSLLPFFDSAYQGFASGSLDTDAHSVRTFVADGGECLIAQSYAKNMGLYGERVGALSIVCKSSDVASKVESQVKLVVRPMYSSPPIHGASIVATILKSSDMYNDWTIELKGMADRIISMRQHLFEALQAKGTPGDWSHIIKQIGMFTFTGLNKEQVAFMTKEFHIYMTSDGRISMAGLSSKTVPHLVEAIHAAVTRVA

SEQ ID NO: 17 - DNA, 1655 bp, Citrus sinensis
cccgggccgcaggccgcctacagttaaactaaccaaaccactccgaggccaatactatattaaacccaaacataattttctcttcacatttttttcccccacaaactctctcatttcattgatttcttgaaagaaatttaatggattctgaatcagtgtttggaaagattgttcgtgctcctgaagatcccattctaggggtcactgttgcttataacaaggatacaagcccagtcaagttgaacttgggtgttggtgcttaccgaactgaggaagggaaacctctggttctgaatgtagtgagaaaggcagagcagctcttagtgaatgaccagtcacgggtcaaagagtatcttcccattgttggacttgtggattttaataaattgagtgcaaagctcatccttggtgctgacagccctgcgattaaagacaacagagtgaccaccgttcagtgcttgtctggcactggttctttgagggttggagctgagtttctggcaaggcattatcaccaacttaccatatatattccacagccaacatggggaaaccatcccaaagttttcactttagcaggattgtctgtgaagacctaccgctattatgatccagcaacacgtgggctaaacttccaaggcttgctggaggatcttagggctgcaccatccggagctatagttcttcttcatgcatgtgctcataatccaactggtgttgacccgacccttgagcagtgggagcagatcaggcagctgatgaggtcaaaaggattgttacctttctttgacagtgcttatcagggttttgcaagtggtagcctagatgcagatgcacaatctgttcgcatgtttgtggcagatggtggcgaatgcctggtagctcagagttatgcgaaaaacatgggactctatggggaacgtgtcggcgccctcagcattgtctgcaagacagaagatgtggcaagcagggttgaaagccagttgaaactcgtgattaggcccatgtactctagtccacctattcacggggcctctattgtggctacaattctcaaggacagcactatgtataaagagtggactcttgaactgaaagcgatggctgaccggattataagcatgcgtcagcaactatttgatgctctgtctgctagaggcactccaggagactggagtcacattatcaagcaaataggaatgtttacattcacagggctgaacagtgaacaagttgccttcatgaccaaggagtatcacatttatatgacatctgatgggaggattagcatggcaggtcttagttcaaagacagttcctcatcttaccgatgctatacatgctgctgtaacccgaatgggctaagattaatcagacaagaattcatgccgtaagaattgtttggttttcagtcaccctcagcaatgcaaaaatgagtttgtagaactagaaaatgcataaataaaggttttacattaagaaaattttgttcttttggttttggtgttgtattcttgtctttccaccaaaacttgacatgtttattaagtagaagaaaaacgaaagttgcgatgttatttatttttgcatttatctttggggagatgccatttacatttttaactctccttgaaacgtttggtgactattttatag

SEQ ID NO: 18 - protein, 407 aa, Citrus sinensis
MDSESVFGKIVRAPEDPILGVTVAYNKDTSPVKLNLGVGAYRTEEGKPLVLNVVRKAEQLLVNDQSRVKEYLPIVGLVDFNKLSAKLILGADSPAIKDNRVTTVQCLSGTGSLRVGAEFLARHYHQLTIYIPQPTWGNHPKVFTLAGLSVKTYRYYDPATRGLNFQGLLEDLRAAPSGAIVLLHACAHNPTGVDPTLEQWEQIRQLMRSKGLLPFFDSAYQGFASGSLDADAQSVRMFVADGGECLVAQSYAKNMGLYGERVGALSIVCKTEDVASRVESQLKLVIRPMYSSPPIHGASIVATILKDSTMYKEWTLELKAMADRIISMRQQLFDALSARGTPGDWSHIIKQIGMFTFTGLNSEQVAFMTKEYHIYMTSDGRISMAGLSSKTVPHLTDAIHAAVTRMG

SEQ ID NO: 19 - DNA, 1421 bp, Centaurea Solstitialis
atcttgacaaaaatgggttccgattccatcttcgccagcatcacccaagcacctgaagatcctatccttggggttactgttgcttacaacaaagattctgatccatcaaaattgaacttgggtgtaggtgcatatcgaaccgaggaagggaaacccctggttctgaatgttgtaaggaaggcagagcaaaagcttgtgaatgatccgtcaagggttaaggagtatcttcccattgttggacttgcagatttcaataaatgtagtgccaaactcatttttggtgctgatagccctgccattcaagagaacagagttgctaccgtgcagtgcttatctggtaccggctcactaagggttggtggagagtttctcgcaaagcattatcatgaacgaacagtatacattccgcagccaacatggggaaaccatccaaaaatctttacgttagcaggattgtcggttaagtcataccgctactatgatcctgccacacgtgggcttgacttccaaggccttctcgaagatctaggtaacgctccatcgggcgcaatagtccttcttcatgcatgtgctcacaacccaacaggcgttgatcctaccatcgagcagtgggagcagatcagacagttaatgagatcaaaagctttgttgcctttcttcgatagtgcctatcagggttttgccagtggcagcctcgatgcagatgcacagcctgttcgcatgttcgttgcagatggtggtgaatgctttgcagctcagagttacgcgaaaaatatgggactctatggggaacgtgttggggcacttagcattgtttgcaaagcagaagatgttgcaaaaagggtagagagccaacttaaactggttatcaggccaatgtattctagtccacctcttcatggggcgtccattgtcgcaactatactcaaggacagtgatttgtacaatgaatggacggttgagctaaaagcaatggctgatcggattatcagcatgcgaaagcagctattggaggccctacaagcaaaaggaacacctggtgattggactcacatcataaagcaaatcggaatgtttacattcacaggacttaatgctgaacaagttgctttcatgacgaaagaatatcacatctacatgacttccgatgggagaatcagcatggctggtctgagttcaaagactatccctcatcttgctgatgctatgcatgctgctgttaccagtatggcttaagccaactccttatttgtcttatcttgtttcgcaccatattttgtagcaattttaaacaaatatcctttttgggtttgaaggattttcaaaccacttcttgaggctttttacaccttcccgttaagccgacgacccaatgtgaaactcgattcacattacataaaaagaagttcactttgtttgct

SEQ ID NO: 20 - protein, 407 aa, Centaurea Solstitialis
MGSDSIFASITQAPEDPILGVTVAYNKDSDPSKLNLGVGAYRTEEGKPLVLNVVRKAEQKLVNDPSRVKEYLPIVGLADFNKCSAKLIFGADSPAIQENRVATVQCLSGTGSLRVGGEFLAKHYHERTVYIPQPTWGNHPKIFTLAGLSVKSYRYYDPATRGLDFQGLLEDLGNAPSGAIVLLHACAHNPTGVDPTIEQWEQIRQLMRSKALLPFFDSAYQGFASGSLDADAQPVRMFVADGGECFAAQSYAKNMGLYGERVGALSIVCKAEDVAKRVESQLKLVIRPMYSSPPLHGASIVATILKDSDLYNEWTVELKAMADRIISMRKQLLEALQAKGTPGDWTHIIKQIGMFTFTGLNAEQVAFMTKEYHIYMTSDGRISMAGLSSKTIPHLADAMHAAVTSMA

SEQ ID NO: 21 - DNA, 1613 bp, Gossypium hirsutum
acgccgtggctcttggaaaagcagaagcgcccatagttcacggtgtttaagacgcccgctgcttcaacaaatcaacctatccctttctcgccttaaaaaacagaatctgaaaccccccccctgattatttgatcactctctaaaaccccagccaaacgagtctttccaaacccaatggattctgtgtttgcctccattgttcaagctcctgaagatcccattcttggggtgacagttgcttataacaaggatccaagcccaaacaagttgaatttaggtgttggtgcttacagaactgaggaaggaaaacctctagttctaaatgttgttcgaaaagcagaacagcttcttgttaatgacctgtcgagagtcaaggagtatcttcctattcttggtctcgcagagttcaataaattgagtgctaagctcattcttggtgatgacagtcctgctattcaagagaacagagtggctactgctcagtgcttgtctggtactggttccttgagggttggagctgagtttttagcaaagcattaccaccaacgtactatatacattccacagccatcatggggaaaccatgtgaaagttttcacgatggcagggttgtcggtgaagaattaccgctactatgatccaacaactcgtgggcttaatttccaaggtttgctagaagatcttggcgcagcaccagctggagctatagtgcttcttcatgcctgtgctcataatccaactggtgttgatccaactgttgagcaatgggaacagatcagacagtcgatgagatctaaagggttattgcctttctttgacagtgcttaccagggatttgcaagtggtagcttagatgcagatgcacaacctgttcgcacgtttgttgcagatggcggggaatgctttatagctcaaagttatgcaaaaaacatgggactttatggggagcgtgttggtgctctcagcattgtctgtaaggcggctgatgttgcaagcagggttgagagccagttgaagcttctgattaggcctatgtattccaatccaccaattcatggtgcctcaattgcaatgactatcctcaaaaatagtgatatgtataacgagtggaagattgaactgaaagctatggcagaccgaattattagcatgcggaaacaactatttgatgctttaagtgctaaaggtactccaggtgactggagtcacattataaagcagattggaatgtttactttcacaggattggacagtgatcaagttgctttcatgatcaaggagtaccacatctacatgacatctgatgggaggattagtatggcaggtcttagctccaagactgtgcctcatcttgctgatgctatacatgctgcagtgacccgtggctgttagaaagcaaattttaaagttctgtagcaagtactttttgggttttagccccatccatgtcatgactgttttcttcttaacttttcaagcacatattattttccataataactgttgggtctggattggaaccagatttttgatatttcgatttcaatgttagacagtacatgtccttttaaacttcatcgtaaatggcatgcttgctattggtatccaaaaaa

SEQ ID NO: 22 - protein, 405 aa, Gossypium hirsutum
MDSVFASIVQAPEDPILGVTVAYNKDPSPNKLNLGVGAYRTEEGKPLVLNVVRKAEQLLVNDLSRVKEYLPILGLAEFNKLSAKLILGDDSPAIQENRVATAQCLSGTGSLRVGAEFLAKHYHQRTIYIPQPSWGNHVKVFTMAGLSVKNYRYYDPTTRGLNFQGLLEDLGAAPAGAIVLLHACAHNPTGVDPTVEQWEQIRQSMRSKGLLPFFDSAYQGFASGSLDADAQPVRTFVADGGECFIAQSYAKNMGLYGERVGALSIVCKAADVASRVESQLKLLIRPMYSNPPIHGASIAMTILKNSDMYNEWKIELKAMADRIISMRKQLFDALSAKGTPGDWSHIIKQIGMFTFTGLDSDQVAFMIKEYHIYMTSDGRISMAGLSSKTVPHLADAIHAAVTRGC

SEQ ID NO: 23 - DNA, 1668 bp, Glycine max
tcattcttcttacataataggggaaggagaagaaaaaaaatgaaataagaaaaactcaactttgtaattcgtggagggaatacttttccattacgcacgcactttaattacagacgagaaaattataattaatagtaatacagacagcagcatgcgcccaccggttattctcaaaactaccacctctcttttggattcttcttcttcttcaccaccctgtgatcgcagactcaacactctcgctagacacttccttccgcaaatggcttctcacgacagcatctccgcttctccaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactggttctttaagagttgggggtgaatttttggctaaacactatcaccaacggactatatacttgccaacaccaacttggggcaatcacccgaaggttttcaacttagcaggcttgtctgtcaaaacataccgctactatgctccagcaacacgaggacttgactttcaaggacttctggaagaccttggttctgctccatctggatctattgttttgctacatgcatgcgcacataaccccactggtgtggatccaacccttgagcaatgggagcagattaggcagctaataagatcaaaagctttgttacctttctttgacagtgcttatcagggttttgctagtggaagtctagatgcagatgcccaacctgttcgtttgtttgttgctgatggaggcgaattgctggtagcacaaagctatgcaaagaatctgggtctttatggggaacgtgttggcgccttaagcattgtctgcaagtcagctgatgttgcaagcagggttgagagccagctgaagctagtgattaggcccatgtactcaagtcctcccattcatggtgcatccattgtggctgccattctcaaggaccggaatttgttcaatgactggactattgagttgaaggcaatggctgatcgcatcatcagtatgcgccaagaacttttcgatgctttatgttccagaggcacacctggcgattggagtcacattatcaaacagattggaatgtttactttcactggattgaatgcggaacaagtttccttcatgactaaagagttccatatatacatgacatctgatgggaggattagcatggctggtctgagttccaaaactgtcccacttctggcggatgcgatacatgcagctgtaacccgagttgtctaaaacatgttgacaacagttttcaacatgctccctagtccctataggagaacttccattatttttgtttaataattgtcaacatcaacaatgaaaccttttatttgatgtgagatttttaaaggaaacttttctgcctaccgggctcc

SEQ ID NO: 24 - protein, 456 aa, Glycine max
MRPPVILKTTTSLLDSSSSSPPCDRRLNTLARHFLPQMASHDSISASPTSASDSVFNHLVRAPEDPILGVTVAYNKDPSPVKLNLGVGAYRTEEGKPLVLNVVRRVEQQLINDVSRNKEYIPIVGLADFNKLSAKLIFGADSPAIQDNRVTTVQCLSGTGSLRVGGEFLAKHYHQRTIYLPTPTWGNHPKVFNLAGLSVKTYRYYAPATRGLDFQGLLEDLGSAPSGSIVLLHACAHNPTGVDPTLEQWEQIRQLIRSKALLPFFDSAYQGFASGSLDADAQPVRLFVADGGELLVAQSYAKNLGLYGERVGALSIVCKSADVASRVESQLKLVIRPMYSSPPIHGASIVAAILKDRNLFNDWTIELKAMADRIISMRQELFDALCSRGTPGDWSHIIKQIGMFTFTGLNAEQVSFMTKEFHIYMTSDGRISMAGLSSKTVPLLADAIHAAVTRVV

SEQ ID NO: 25 - DNA, 1660 bp, Gossypium raimondii
ttttgccgtaaaaccaaacaggaaaaagtaagcgaaaattcatcattcaaacgtaccgaacaagctaaaatgcgccccgaattcacgtcaccgtcttcttcttcatcttcgtcggccgatcgtcggttaaacgctctggtccgacacctcgcaaccgcatcaatggtgtctcaaaccgccgtagcattttctcccacctccgggtttcatggagactccgttttctctcacgtcgttcgcgcccctgaagatcccattctcggagtgactgttgcatataacaaagatcccagccccgttaagttgaatttaggagttggtgcttatcgaactgaggaagggaagcctcttgttcttaatgtggtgagaaaagctgaacaaatgttgttgaacgataaatcacgtgttaaggaatatcttcccattgttggaatagcagagtttaataaattaagtgctaaacttatttttggtgctgacagccctgctattcgagagaatcgggttactacagttcagtgtttatctgggacgggttcattgagagttggagctgaatttttggctaggcattatcatcaaaaaactatatacattccacagccaacatggggaaatcaccccaaggtttttactttggcaggattatctgtgaaaacttaccgctattatgatccaacaacacgcggaatgaatttccaggggttattggaggaccttggctctgccccttctggatcaattgtgcttcttcatgcatgtgctcataatcccactggagtcgatcccacccttcagcagtgggagcaaattaggcagttgatgagatcgaaggcattgttacctttctttgatagtgcttatcagggttttgccagtggaaatcttgatgaagatgcacagtcgattcgtatgtttgttgctgatggtggtgaatgctttgtagctcagagttatgcaaagaacatgggcctctatggcgaacgtgttggtgcattgagtgttgtctgcagggcagccgatgtagcaagcaaggtcgaaagtcagctcaagcttgttattcggccaatgttttcaaatccaccaattcatggtgcatctattgtggcaaccatcctgaaggacagcaacatgttcaatgaatggactattgagttgaaggcaatggctgaccgtatcatcagcatgcgcaaacaactttttgatgctttgcgtgctagaggaacacctggtgactggagtcatatcatcaaacaaattggaatgtttaccttcaccggactaaattcaaagcaagtggaattcatgaccagagaataccatatctacatgacttctgatgggaggattagcatggcaggactgagttcaaagacagtccctcatctggctgatgcaattcatgctgcagttactcgtatgtcatagaaattgggcttagcacacacagcaggtcctcaatacacttgattgggaatcacatcaaatgagtatttgtttttcactttaccattcaataataactgtatttgaacaaaattgtagccctcaaaacactgaaagggcagaaagaaataaactcacttccacttgcttatattgttgtggtttttgtcaatggctaagatagcatttataaaacctttccatgctaatagtc

SEQ ID NO: 26 - protein, 452 aa, Gossypium raimondii
MRPEFTSPSSSSSSSADRRLNALVRHLATASMVSQTAVAFSPTSGFHGDSVFSHVVRAPEDPILGVTVAYNKDPSPVKLNLGVGAYRTEEGKPLVLNVVRKAEQMLLNDKSRVKEYLPIVGIAEFNKLSAKLIFGADSPAIRENRVTTVQCLSGTGSLRVGAEFLARHYHQKTIYIPQPTWGNHPKVFTLAGLSVKTYRYYDPTTRGMNFQGLLEDLGSAPSGSIVLLHACAHNPTGVDPTLQQWEQIRQLMRSKALLPFFDSAYQGFASGNLDEDAQSIRMFVADGGECFVAQSYAKNMGLYGERVGALSVVCRAADVASKVESQLKLVIRPMFSNPPIHGASIVATILKDSNMFNEWTIELKAMADRIISMRKQLFDALRARGTPGDWSHIIKQIGMFTFTGLNSKQVEFMTREYHIYMTSDGRISMAGLSSKTVPHLADAIHAAVTRMS

SEQ ID NO: 27 - DNA, 1543 bp, Helianthus annuus
cgggggtttccagaatgtaatcacaagccttgtcaggcaaagcattttcaacctgatgttagtttgcgtgccgcccacggtatttccataataaatcagcagctaaaatccgtctgagatttgcatataaacccacccccaatttcttattctctctcacaaattcaataataattcttgaagaacaaaaaaaatggctgatcattcaagctccgttttctctcaaatcgttcgtgctcctgaagatcccatcttaggggttactgttgcttacaacaaagattcagacccatcaaagttgaatttgggtgtaggtgcttatagaactgaggaagggaaacctttggttctcaatgttgtaagacaggcagaacaaaagcttgttaatgatccgtctcgggttaaggagtatcttcccattgttggacttgcagattttaataagggtagtgcaaagctcatttttggtgctgatagccctgcaattcaagagaacagagtcactaccgtgcagtgtttatccggaaccggctcactaagggtcggtggagagtttcttgcaaagcattactatgaaaaaacggtatacattccatctccaacatggggaaaccatccgaaaatcttcactttagccggattatccgtaaagacataccgttactatgatcctgccacacgtgggcttgacttccaaggccttctggaagatttgggtaacgctccaacgggagcaatagtcctccttcacgcatgtgctcacaatccaactggcgtcgatccaacccttgatcagtgggaacagatccgaaaattgatgagatcgaaagggttgttaccgtttttcgatagtgcgtatcagggttttgcaagtggcagcctcgatgcagatgcacaatctgttcgaatgtttgttgctgatggcggtgaatgctttgcagctcaaagttatgctaaaaatatgggactttacggcgaacgtgttggagcccttagcattgtttgcaaaaccgccgacgttgcaagcagggtagagagtcaacttaaattggttattaggccaatgtattcgagtccgcctcttcatggtgcgtctattgttgcaactatacttaaagacagtaatttgtacaatgagtggacggttgagcttaaagcaatggctgatcggattatcagcatgcgcaagcaattattagaagccctacaagcaagaggaacaccgggtgactggactcacattataaagcaaatcggaatgtttactttcaccgggctgaacgctgaacaagttgctttcatgacaagagagtatcacatctacatgacttccgatgggagaatcagcatggctggtctaagttcaaagactgtacctcatcttgcggatgctatgcatgctgctgttacccgtgttgcgtaaacaagcatgttttgttgtaagtcttaataaagctgtttttggattactttaagccggcatgattatcgcctaatctggaaactttattgacattattaaattgagccacttggttttgcg

SEQ ID NO: 28 - protein, 409 aa, Helianthus annuus
MADHSSSVFSQIVRAPEDPILGVTVAYNKDSDPSKLNLGVGAYRTEEGKPLVLNVVRQAEQKLVNDPSRVKEYLPIVGLADFNKGSAKLIFGADSPAIQENRVTTVQCLSGTGSLRVGGEFLAKHYYEKTVYIPSPTWGNHPKIFTLAGLSVKTYRYYDPATRGLDFQGLLEDLGNAPTGAIVLLHACAHNPTGVDPTLDQWEQIRKLMRSKGLLPFFDSAYQGFASGSLDADAQSVRMFVADGGECFAAQSYAKNMGLYGERVGALSIVCKTADVASRVESQLKLVIRPMYSSPPLHGASIVATILKDSNLYNEWTVELKAMADRIISMRKQLLEALQARGTPGDWTHIIKQIGMFTFTGLNAEQVAFMTREYHIYMTSDGRISMAGLSSKTVPHLADAMHAAVTRVA

SEQ ID NO: 29 - DNA, 1336 bp, Helianthus paradoxus
cgcggggaattataatataattcttgaagaaaaaaaaaaaaaatggctgatcattcaagctccgttttctcccaaatcgctcgtgctcctgaaaatcccatcttaggggttactgttgcttacaacaaagattcagacccatcaaagttgaatttgggtgtaggtgcttatagaactgaggaagggaaacctctggtgcttaatgttgtaagacaggcagaacaaaagcttgttaatgacccgtctcgggttaaggagtatcttcccattgttggacttgcagattttaataagggtagtgcaaagctcatttttggtgctgatagccctgcaattcaagagaacagagtcgctaccgtgcagtgtttatccggaaccggctcactaagagtcggtggagagtttcttgcaaagcattactatgaaaaaacggtatacattccatctccaacatggggaaaccatccaaagatcttcactttagccggattatctgtaaagacataccgttactatgatcctgcaacacgtgggcttgacttccaaggccttttggaagatttgggtaacgctccaacgggagcaatagtcctccttcacgcatgtgctcacaatccaactggcgtcgatccaacccttgatcagtgggaacagatccgaaaattgatgagatcgaaagggttgttaccgtttttcgatagtgcatatcagggttttgcaagtggcagcctcgatgcagatgcacaatctgttcgaatgtttgttgctgatggcggtgaatgctttgcagctcaaagttatgctaaaaatatgggactttacggcgaacgtgttggagcccttagcattgtttgcaaaacggccgatgttgcaagcagggtagagagtcaacttaaattggttattaggccgatgtattcgagtccacctcttcatggtgcgtctattgttgcaactatacttaaagacagtaatttgtacaatgagtggacggttgagcttaaagcaatggctgatcggattatcagcatgcgcaagcaattattagaagccctacaagcaagaggaacaccgggtgactggactcacattataaagcaaatcggaatgtttactttcaccgggctgaacgctgaacaagttgctttcatgacaagagagcatcacatctacatgacttctgatgggagaatcagcatggctggtctaagttcaaagactgtacctcatcttgcagatgctatgcatgctgctgttacccgtgttgcgtaaacaagcatgttttgttgtaagtcttaataaagctgtttttggattactttgagccgcggcatga

SEQ ID NO: 30 - protein, 409 aa, Helianthus paradoxus
MADHSSSVFSQIARAPENPILGVTVAYNKDSDPSKLNLGVGAYRTEEGKPLVLNVVRQAEQKLVNDPSRVKEYLPIVGLADFNKGSAKLIFGADSPAIQENRVATVQCLSGTGSLRVGGEFLAKHYYEKTVYIPSPTWGNHPKIFTLAGLSVKTYRYYDPATRGLDFQGLLEDLGNAPTGAIVLLHACAHNPTGVDPTLDQWEQIRKLMRSKGLLPFFDSAYQGFASGSLDADAQSVRMFVADGGECFAAQSYAKNMGLYGERVGALSIVCKTADVASRVESQLKLVIRPMYSSPPLHGASIVATILKDSNLYNEWTVELKAMADRIISMRKQLLEALQARGTPGDWTHIIKQIGMFTFTGLNAEQVAFMTREHHIYMTSDGRISMAGLSSKTVPHLADAMHAAVTRVA

SEQ ID NO: 31 - DNA, 1670 bp, Juglans regia
cgcgcggggacaaacaaacacgcgcacccgatcgaaatagaaagtagggtggggtctaaaatgcgcccacaggtaacctcaaccgaagcccattgtattgatacacctcgtgctttttcttcatcaatcgatcgaaggttgaacactctggtgagacaccttgttgccccatcgctcctgctcgactctcagattcggaacgatatcatgtctgcctctcccacctccggctttcatgccgattccgtcttcgctcacatcgatcgcgctcccgaagatcccatcctcggggtaactgttgcatataacaaagatccaagccccattaagctgaatttgggagttggcgcttaccggaccgaggaaggcaaacctcttgttctgaatgtagtgagacaagcagagcagcagcttgttaatgacaggtcacgcgtgaaggaatatcttccgattgttggactggcagacttcaataaattgagtgctaaacttattcttggtgctgacagccctgccgtccaagagaacagggttacaactgtccaatgcttgtctggtactggctcattgagagtcggtggtgaatttttggcgagacattatcatcaactcacaatttacattcccctgccaacatggggaaaccatccaaaagtatttactctagcaggtctatctgtgaaaacttaccgctattatgatccagcaacacgtgggctgaacttccaaggcctcctagaagaccttggttctgccccatctggagctattgtgttactccatgcatgtgcacacaaccctactggtgttgatccaaccattcagcagtgggagcagatcaggcagctgatgagatcaaaaagtttattgcctttcttcgacagtgcttatcaaggttttgcaagtggaagtctggatgcagatgcacagccagttcgtatgtttgttgccgatggtggtgaatgccttgtagctcaaagttatgccaagaacatgggactctatggtgaacgtgttggcgccttgagcatagtctgcaagacagctgatgttgcaagcagagttgagagccagcttaaacttgtcatcagaccaatgtattcaaacccacccattcatggtgcatctattgtggctacaatcctcaaggacagggacatgtacaatgaatggactattgaattgaaggaaatggctgaccgtattatcagcatgcgccagaaactttttgatgccttacgcgcaagaggtacaccaggggactggagtcatattattaagcagattggaatgtttactttcacgggattgaactcggaacaagttgctttcatgacaagagaataccacatatacatgacttctgatgggagaattagcatggcgggcctgagctccaagacggtcccccatcttgcagatgcaattcatgcagcagttactcgcgtggtctgattcttttgctggcctagtgagactctggaaggcctctccccacatcgggggactctttttccattttgctattttgttgtaataatggctacctcaagtaccgagtgcttcaagctgtcagtgcttcataattgaggtaatatctcaagagatatttggttttgagctttaaactctgcctctgggcacgtatttttacagcttgtatttgtagt

SEQ ID NO: 32 - protein, 464 aa, Juglans regia
MRPQVTSTEAHCIDTPRAFSSSIDRRLNTLVRHLVAPSLLLDSQIRNDIMSASPTSGFHADSVFAHIDRAPEDPILGVTVAYNKDPSPIKLNLGVGAYRTEEGKPLVLNVVRQAEQQLVNDRSRVKEYLPIVGLADFNKLSAKLILGADSPAVQENRVTTVQCLSGTGSLRVGGEFLARHYHQLTIYIPLPTWGNHPKVFTLAGLSVKTYRYYDPATRGLNFQGLLEDLGSAPSGAIVLLHACAHNPTGVDPTIQQWEQIRQLMRSKSLLPFFDSAYQGFASGSLDADAQPVRMFVADGGECLVAQSYAKNMGLYGERVGALSIVCKTADVASRVESQLKLVIRPMYSNPPIHGASIVATILKDRDMYNEWTIELKEMADRIISMRQKLFDALRARGTPGDWSHIIKQIGMFTFTGLNSEQVAFMTREYHIYMTSDGRISMAGLSSKTVPHLADAIHAAVTRVV

SEQ ID NO: 33 - DNA, 1816 bp, Lotus japonicus
ttcaaactttattcccagggacccaaccaaagcatatacatacacacattcagcatgcgcccaccggttcttctcgaaactacctctttttcttcttcttcttcttccccaagcgatcgcagactcaacgttctcgcaggccacctcgttcacaacgatcaaatggattctcagaacatctctccttctccaaccgcctcttctggttccgtcttcgctcatctcgttcgtgctcccgaagatcctattctcggggtgactgtcgctttcaacaaagatcctagccctgttaagctcaacttgggtgttggtgcttaccgaactgaggaaggaaaacctcttgttttgaatgtggtcaggaaagctcaacaccaaatcgtgaatgatccgtcacgcaacaaggagtatcttccaattgtggggctcgctgattttaataaattgagtgccaagcttatttttggtgctgacagccctgctattcaagagaacaggattaccactgttcagtgcttgtctggtactggttcattaagagttgggggtgaatttttggctaaacactatcaccaacggattatatacttgccaaaaccaacttggggcaatcacacaaaggttttcaccttggcagggttatctgtcaaaacatatcgctactatgctccagcaacacgagggcttgactttcaaggacttctagaagatcttggttctgccccatctggatccattgttttgctacatgcatgcgctcataaccctactggtgttgatccaacccctgagcaatgggagcagattaggcagctgataagatcaaaggctttattacctttctttgacagtgcttatcagggttttgctagtggaaatctagatgcagatgcacattctgttcgttcatttgttgctgatgggggtgaattgctggcagcccagagttatgcaaagaacatgggtctttatggagaacgtgttggtgccttaagcattgtctccaagtcagctgatgttgcaagtttggttgagagtcagctgaagcttgtcatcaggcccatgtactcaaatcctccccttcatggtgcatccattgtagctacgattcttaaggaccgggatttgtacaatgagtggactattgagttgaagggaatggctgatcgtattatcagtatgcgccaacaactttttgatgctttacgttccagaggcacgcctggtgactggagtcacattatcaagagtatcggtatgttcactttcacaggattgaatcctgagcaggtttccttcatgactaaagagtaccatatatacctgacatccgatgggcggattagcatggctggtttgagttccaaaaccgtcccacatctggcggatgctatacatgcggctgtaacccgagcttcctgaacatgtttggaaagatatctcaaccatagatgaaaaaatcaactgttagatattaacaaatcatggatttgttgaaatatactcttgattttctcatcaaccattgagatacctttactttctccctttaaagctttagaggagccaaattctatgagcgagcgcgattttcaactcacctagtaggacttccattttcaatgtaataatatcacatcaaacaatgaaaacttttttttgatgtgagaattagagacaacttttctgcccagggtgcctcggtctccgatcttggcattctaacattttcgccaagttttcctagtgtaagcatgatcaagtgcccccaagaaggaggctttctattttctaaataatttctgaaggataaagtacc

SEQ ID NO: 34 - protein, 454 aa, Lotus japonicus
MRPPVLLETTSFSSSSSSPSDRRLNVLAGHLVHNDQMDSQNISPSPTASSGSVFAHLVRAPEDPILGVTVAFNKDPSPVKLNLGVGAYRTEEGKPLVLNVVRKAQHQIVNDPSRNKEYLPIVGLADFNKLSAKLIFGADSPAIQENRITTVQCLSGTGSLRVGGEFLAKHYHQRIIYLPKPTWGNHTKVFTLAGLSVKTYRYYAPATRGLDFQGLLEDLGSAPSGSIVLLHACAHNPTGVDPTPEQWEQIRQLIRSKALLPFFDSAYQGFASGNLDADAHSVRSFVADGGELLAAQSYAKNMGLYGERVGALSIVSKSADVASLVESQLKLVIRPMYSNPPLHGASIVATILKDRDLYNEWTIELKGMADRIISMRQQLFDALRSRGTPGDWSHIIKSIGMFTFTGLNPEQVSFMTKEYHIYLTSDGRISMAGLSSKTVPHLADAIHAAVTRAS

SEQ ID NO: 35 - DNA, 1334 bp, Lactuca perennis
aattccaacttcagaatccattttcatacaaaaccccagttctatctcaaaatcacactcatcttctaaatcattacagcaaatctccagaagaaatatgactcactcggattccgtcttctcccaaatcgctaaagctcctgaagatcctatcttaggggttactgttgctttcaacaaagatacagactcttcaaagctgaatttgggtgtaggtgcttatagaactgaggaaggaaaaccactggttctgaatgttgtaaaacaggctgaacaaaagcttgttaataatccgtctcggattaaggagtatcttccaattgttggacttgcagattttaataaaggtagcgccaaactcatttttggtgctgatagccctgccattcaagaaaaccgagtcgccactgtccaatgcttatctggcactggctcactgcgagttggtggagagtttttagcaagacattatcatgaaaaaaccatatacattccaaacccaacatggggaaaccatccaaaaatcttcacatttgcaggattatcagtcaagacttatcgctactatgaccccacaacacgtggccttgacttcaaaggccttctagaagatctgggtaatgctccatcaggagcaatagtacttcttcatgcatgtgctcacaacccgacaggtgtcgatcccaccattgaacaatgggaggagatcagacagttagtcaggtcaaaagaattgttaccttttttcgacagtgcgtatcagggttttgctagtggcagcctggatgcagatgcaaaacccgttcgcttgtttgttgcagatggtggtgaatgctttaccgctcaaagttatgccaaaaatatgggactttacgccgaacgtgttggtgcccttagcattgtttgcaaaacgtcagatgttgcgagcagggtagagagccagctaaaactagttatccggccaatgtattctagcccacctcttcatggagcatctattgtctcaactatactcaacaacagtaatttgtacaatgagtggacgcttgagctcaaagcaatggctgaccggattatcagcatgcgtacacaactattggaagccctaaaagcaaaaggaacaccgggtgactggactcatatcataaagcaaattggaatgttcactttcactgcgctgaatgcagaacaagttgctttcatgactaaagaatatcatatctacatgacttctgatgggagaatcagcatggctggtttgagttcaaagacaatccctcatcttgcagatgctatgcacgctgctgttacaacaatggcgtaaacaaaacaac

SEQ ID NO: 36 - protein, 408 aa, Lactuca perennis
MTHSDSVFSQIAKAPEDPILGVTVAFNKDTDSSKLNLGVGAYRTEEGKPLVLNVVKQAEQKLVNNPSRIKEYLPIVGLADFNKGSAKLIFGADSPAIQENRVATVQCLSGTGSLRVGGEFLARHYHEKTIYIPNPTWGNHPKIFTFAGLSVKTYRYYDPTTRGLDFKGLLEDLGNAPSGAIVLLHACAHNPTGVDPTIEQWEEIRQLVRSKELLPFFDSAYQGFASGSLDADAKPVRLFVADGGECFTAQSYAKNMGLYAERVGALSIVCKTSDVASRVESQLKLVIRPMYSSPPLHGASIVSTILNNSNLYNEWTLELKAMADRIISMRTQLLEALKAKGTPGDWTHIIKQIGMFTFTALNAEQVAFMTKEYHIYMTSDGRISMAGLSSKTIPHLADAMHAAVTTMA

SEQ ID NO: 37 - DNA, 1429 bp, Lactuca perennis
cgggggaaaagagcggggcagacgcaatacacaaacggaaaacgtaaacaagtcaaaaatgaactcctcgtcggcagatcggaggttgtatatgctttcacgtcacctcgccggagagattggtaatgaaggtagtggtatctcatcttccccaacttctgccggaaattctgtcttcgctaacgtagttcgtgctcccgaagatccgattctcggggtgactgttgcttataacaaagacccaagccctatcaagctaaatttaggcgttggtgcttatcgtacagaggaaggaaaacctctggtcctaaatgtggtgagaaaagcagagcagctacttgtgaatgacaggtctcgtgtcaaggaatatctccccattgttggattagcagattttaacaaattaagtgcaaaacttatactcggagctgacagtcctgctatccagggaaaccgggtgacaacagtacagtgtttgtctggtactgggtcattgcgagttggaggcgagtttctatccaaacactattaccaacgtactatatatataccaaatccaacatggggaaaccatacaaaaatattcactcttgctggtttgactgtgaaaacatatcgctactatgatccagtgacacgtggattgaacatccaaggcttactagaagaccttaattctgctccatctggatcaattgttcttctacatgcatgtgctcataatcccacaggtgttgatccaacacttgaacaatgggagcaaataagacagctgattagatccaaaaatctcttaccattttttgatagtgcatatcagggttttgcaagtggaagtctagataaagatgctcaatcagttcgcatgtttgttggtgatggtggcgaatgctttatagctcaaagttatgctaaaaatatgggcctttatggcgaaagagttggtgctttgagcattgtttgtaggagtgctgacgtggcaagtagggtagagagcctgttaaaacttgtgataaggcctatgtactcaagtccacccatccatggtgcttcaattgtggctaccattctcaaagacagaaagttgtatgatgaatggacacttgaattgaaggcaatggctgatcgtattattaccatgcgaaaacagctttttgatgctttatctgctagagggacacctggcgactggagccacattataaagcaaatcgggatgtttacattcacagggcttaatacaaagcaagtaaccttcatgacaaaagacttccacatctacatgacatctgatgggcgtattagcatggcgggtttaagctcaaggactgttcctcaccttgcagatgcgatacatgctgctgtaaccactgttggttaaattaagtaagttggttgattgctaatttttaattatatttttttttta

SEQ ID NO: 38 - protein, 440 aa, Lactuca perennis
MNSSSADRRLYMLSRHLAGEIGNEGSGISSSPTSAGNSVFANVVRAPEDPILGVTVAYNKDPSPIKLNLGVGAYRTEEGKPLVLNVVRKAEQLLVNDRSRVKEYLPIVGLADFNKLSAKLILGADSPAIQGNRVTTVQCLSGTGSLRVGGEFLSKHYYQRTIYIPNPTWGNHTKIFTLAGLTVKTYRYYDPVTRGLNIQGLLEDLNSAPSGSIVLLHACAHNPTGVDPTLEQWEQIRQLIRSKNLLPFFDSAYQGFASGSLDKDAQSVRMFVGDGGECFIAQSYAKNMGLYGERVGALSIVCRSADVASRVESLLKLVIRPMYSSPPIHGASIVATILKDRKLYDEWTLELKAMADRIITMRKQLFDALSARGTPGDWSHIIKQIGMFTFTGLNTKQVTFMTKDFHIYMTSDGRISMAGLSSRTVPHLADAIHAAVTTVG

SEQ ID NO: 39 - DNA, 1551 bp, Nicotiana tabacum
ggccattacggccgggggtcactccataaattcctcaagaaagatcacacttccattacatctttgaagtttttctctgaagaaatcccattcattttttcaaaatggcaaattcctccaattctgtttttgcccatgttgttcgtgctcctgaagatcccatcttaggagtcacagttgcttataacaaagataccagcccagtgaagttgaatttgggtgttggcgcatatcgcactgaggaaggaaagccccttgttcttaatgtggtgagacgggctgaacaaatgctcgtcaatgacacgtctcgggtgaaggagtatctctcaattactggactagcggattttaacaaactgagtgcaaagcttatatttggtgctgacagccctgccattcaagagaacagggtgactactgttcagtgcttgtcgggcacaggttctttgagggttggggctgaatttctggctaagcattatcatgaacataccatatatataccacagccaacatggggaaaccatccgaaggttttcactttagccgggctttcagtaaaatattaccgttactacgacccagcaacacgaggcctggatttccaaggacttttggatgatcttgctgctgcacccgctggagcaatagttcttctccatgcatgtgctcataacccaactggcgttgatccaacaaatgaccagtgggagaaaatcaggcagttgatgaggtccaagggcctgttgcctttctttgacagtgcttaccagggttttgccagtggcaacctagatgcagatgcacaatctgttcgcatgtttgtggctgatggtggtgaatgtcttgcagctcagagttatgccaaaaacatgggactgtatggggagcgtgttggtgcccttagcattgtttgcaaagacgcagatgttgcaagcagagtcgaaagccagctaaagctggttatcaggccaatgtactctaatccaccaattcatggtgcgtctattgttgctactatactcaaggacagacaaatgtacgatgaatggacaattgagctgaaagcaatggccgacaggattattagcatgcgccaacaactctttgatgccttgcaagctcgaggtacgacaggtgattggagtcatatcatcaagcaaattggaatgtttactttcacaggattaaatactgagcaagtttcattcatgactagagagcatcacatttacatgacatctgatgggagaattagcatggcaggccttagttctcgcacaattcctcatcttgccgatgccatacatgctgctgttaccaaagcggcctaaatgagttcagttgcattcaagagcagtctaattgagaaactgagtctgtttttccttgatcgcttccttatcctttgatgttaaataaaaacttgtatgactatatagacatagtatttggatgtcagattttgaaatcccattattaagggatttgatgaatgcaaatcaccttccgtcaaattattaagttagcctgaatgttatgaattcttaa

SEQ ID NO: 40 - protein, 409 aa, Nicotiana tabacum
MANSSNSVFAHVVRAPEDPILGVTVAYNKDTSPVKLNLGVGAYRTEEGKPLVLNVVRRAEQMLVNDTSRVKEYLSITGLADFNKLSAKLIFGADSPAIQENRVTTVQCLSGTGSLRVGAEFLAKHYHEHTIYIPQPTWGNHPKVFTLAGLSVKYYRYYDPATRGLDFQGLLDDLAAAPAGAIVLLHACAHNPTGVDPTNDQWEKIRQLMRSKGLLPFFDSAYQGFASGNLDADAQSVRMFVADGGECLAAQSYAKNMGLYGERVGALSIVCKDADVASRVESQLKLVIRPMYSNPPIHGASIVATILKDRQMYDEWTIELKAMADRIISMRQQLFDALQARGTTGDWSHIIKQIGMFTFTGLNTEQVSFMTREHHIYMTSDGRISMAGLSSRTIPHLADAIHAAVTKAA

SEQ ID NO: 41 - DNA, 1892 bp, Picea glauca
gcacgaatatccattcaaacactattattagctttgagcagaatgatggggaagagctcatccacttgttcgtttgaggagaaggaaagtgataaaagtttaagtgtcgcgggtaggagaattggatcgcttgtgaggcaattagctgcaacttcaatggaggggcaagcagatagagatggtgatcttcgttttcagccaactgcgggttctgcagtctctgcattccaacacttggaacaggctcccgaggatccaattcttggggtgacagttgcctataacaaggatccgagccctgtgaaattgaatttgggtgttggggcgtatcgaactgaggaaggaaaacctctcgtgctggatgttgtcaggcaagcagaggagctcttaattcaagacaggtctcgatataaggagtatattcctatagctggtcttgtagagttcaacaaactaagtgcgaagctgattcttggtgatggaagtcctgctattggggagaaaagggttgccactgcacaatgcttatctggaacaggttcactcagggttggagctgagtttctgtcaaagcattatagccaacacataatttatattccagtacccacatggggtaaccatcccaagatctttaatcttggaggattgagtgtgaagacatatcgctattatgatcccagaacaagtgggcttgattacgaaggtatgcttgaagatctacattcagctcctcctggagctatagtgcttcttcatgcatgtgcacataatccgactggtgtagatcctacacaagaccaatgggaaggaattcggcaattaatcagattaaaaggtctgctgccattttttgacagtgcttatcagggatttgccagtggaagccttgatgcagatgcatactctgttcgtctgtttgtaggagatggtggtgaatgccttattgctcagagttttgcaaagaatatggggctgtatggggagcgtgtgggtgctcttagtattgtttgcaggagtgcaacagtggcaactagagttgaaagtcagttgaaattggttattcggccaatgtactcaagcccccctattcacggtgcttcgattgtggcaacaattctcagtgacaggaatctttattacaattggactgttgaattgaaaaacatggcagatcgcattattagtatgcgccatcagctctatgatgctctgaaggctcgtggaacccctggagactggagccacattattaagcagattggaatgttcacttttactggcctgaacaaagatcaagtttcatttatgactgcagaataccatatttatttgacttctgatgggcggataagtatggcaggtctgagctctaaaacagtcccacaccttgcagatgctatccatgccgctgttctccgccttggttagcagcatggttttccatacaataacttttgtgcataaaataaaacatgcaaggcctgaacttgcaaagcagattttcttgcaagaggcaaagagctgcagaattttttatcatatcatttgatttttcgtgcaattcatcaattaccgagacttggataattagtgcacatagcttctcttttcaaagtgataaactttgatattatgtagcaactcatccttttatcaaaatccctctttttactatttgctagtttatcgaccgaaatgatgttaatacaatcatgaaccaatatgcaatagttgcttaggatttttcttgtatatcagatactgtcacatcagctggaggattataacttatagtacatgctcattgttctgctactatggattttttgcatgaaatactctacgagggaattatcctttgtattcattatattccgatacacagttta

SEQ ID NO: 42 - protein, 462 aa, Picea glauca
MMGKSSSTCSFEEKESDKSLSVAGRRIGSLVRQLAATSMEGQADRDGDLRFQPTAGSAVSAFQHLEQAPEDPILGVTVAYNKDPSPVKLNLGVGAYRTEEGKPLVLDVVRQAEELLIQDRSRYKEYIPIAGLVEFNKLSAKLILGDGSPAIGEKRVATAQCLSGTGSLRVGAEFLSKHYSQHIIYIPVPTWGNHPKIFNLGGLSVKTYRYYDPRTSGLDYEGMLEDLHSAPPGAIVLLHACAHNPTGVDPTQDQWEGIRQLIRLKGLLPFFDSAYQGFASGSLDADAYSVRLFVGDGGECLIAQSFAKNMGLYGERVGALSIVCRSATVATRVESQLKLVIRPMYSSPPIHGASIVATILSDRNLYYNWTVELKNMADRIISMRHQLYDALKARGTPGDWSHIIKQIGMFTFTGLNKDQVSFMTAEYHIYLTSDGRISMAGLSSKTVPHLADAIHAAVLRLG

SEQ ID NO: 43 - DNA, 1230 bp, Physcomitrella patens
atggctccctctgtgtttgagcacgttcagcaagcacccgaggatcccattttgggggtaacagtggcttacaacaaggatccaagtccattgaaggtgaaccttggagtcggagcctaccgaacagaggaaggcaaaccacttgttctcaatgtggtacggcgagcagaacaacagttggttgcagatagatcgaggaacaaggagtaccagcccattacaggaatttctcagttcaacaaacttagcgcaaagcttattctgggcgctaatagtccagcaattgcagagaaccgtgttgccaccgtgcaagccttatccgggactggtgccttgagggttggcgcagagttcatatcgaggcattatgccaagccaattatattcttgcctaatccaacgtggggaaatcacaacaagattttcccgttgggaggagtgcctcagaagccatacagatattatgaccctaagacgcgcggattggactacgaaggtatgttggaggacttgaaggcagcccctgatggcgcagtcattttgctccatgcgtgtgcacacaatcccactggtgttgacccgactgaagagcagtgggaagggattcgacaggttattagaagcaagcatcagcttcccttttttgactgtgcataccagggattcgctagtggaagtctggacaaagacgcccatgctgttcgcttatttgtagctgatggtggggaatgttttgttgcacaaagttatgctaagaacatgggactttatggagagcgagtcggtgcattaagcgtcgtgtgtacgaatgctgctgtggcaagtcgggtagacagtcagttaaaactggtcatccgccccatgtactctagccccccggctcatggtgcagccattgcagcgacgattctagctgacgggcgtcttttccaggaatggacggtagagttgaagggtatggcagatcggattattagcatgcgtcaacagctctatgacgctctgcaagctcgaggcacacctggcgattggactcacgttctgaagcagattggaatgttcactttcacgggattgaacaagtctcaagtcgagttcatgacccgtcaatatcacatctacatgacctcagatgggcgtataagtatggctggattaagcagcaaaactgttccacatttggcggacgcaattcatgcagctgtggttggagctcagcgcaagagttag

SEQ ID NO: 44 - protein, 409 aa, Physcomitrella patens
MAPSVFEHVQQAPEDPILGVTVAYNKDPSPLKVNLGVGAYRTEEGKPLVLNVVRRAEQQLVADRSRNKEYQPITGISQFNKLSAKLILGANSPAIAENRVATVQALSGTGALRVGAEFISRHYAKPIIFLPNPTWGNHNKIFPLGGVPQKPYRYYDPKTRGLDYEGMLEDLKAAPDGAVILLHACAHNPTGVDPTEEQWEGIRQVIRSKHQLPFFDCAYQGFASGSLDKDAHAVRLFVADGGECFVAQSYAKNMGLYGERVGALSVVCTNAAVASRVDSQLKLVIRPMYSSPPAHGAAIAATILADGRLFQEWTVELKGMADRIISMRQQLYDALQARGTPGDWTHVLKQIGMFTFTGLNKSQVEFMTRQYHIYMTSDGRISMAGLSSKTVPHLADAIHAAVVGAQRKS

SEQ ID NO: 45 - DNA, 1681 bp, Prunus persica
cttggaacgaataaaactgcctaacatgcgcccacagttcacatcacccgacgcccatagttcttcacctgccctttcttcttcttcttcttcttcttctttttcaagcagcagtgatcggaggatcaacgctctcgtgcgtcaccttgattcgtctgccatggatcctaacaacaacagctcaatctctgcttcgccaacttcggcacatgccaattctgtcttcgctcacgtcgttcgcgcccctgaggatccaatacttggggtgactgttgcatacaacaaagatccgagcccagctaagttgaatttgggtgttggtgcttatcgaactgaggaaggaaaaccacttgttctgaatgtagtgaggaaagcagaacagctgcttgttaatgacaggtctcgcgttaaggaatatttgcctattgttggactggcagatttcaataaactgagtgctaagctgattcttggtgctgacagccctcctattcaagagaaccggattactactgtccaatgtctgtcaggaactggctcattgagagttggaggtgaatttttggcaaagcattatcatgaacgcacaatatacataccccagccgacatggggaaaccacacaaaagttttcactctggcagggttgtctgtgaaaagttaccgatattatgatccagcaacgcgtggcctcgacttccaaggcctcttagaagaccttcgttctgccccagctggagcaattgtacttctccatgcatgtgctcataaccccactggtgttgatccaacccttgagcagtgggagcagatcagacagcttgtgagatcaagaggattattaccattctttgacagtgcttatcagggttttgctagtggaagtttggatgcagatgcagagtctgttcgtaggtttgctgctgatggtggagagtgcctcatagctcaaagttacgcgaaaaacatggggctctatggagaacgtgttggtgccctaagcattgtctgcaagactgctgatgttgcaagtaaggttgagagccaagtgaagcttgtgatcaggcccatgtattcaaaccctcccattcacggtgcatctattgtagccaccattctcaaggatagggacttgttcaacgaatggacaattgagttgaaggcaatggctgaccgtatcatcagcatgcgacatcaactgtttgaatccttgcgcgccaagggcacacctggtgactggagccacatcatcaagcagattggaatgtttaccttcacaggattgaactccgagcaagttgctttcatgactaaagagtaccatatctacatgacatctgatgggaggatcagcatggctggtctgagttcgaggaccgtcccccatcttacagaggcaatacatgcagctgttactcgcgttgcctaaatcatgtttccagggcaacattttttccttttttgtgagccaaatccatatcggattctaccctttccagattttttgttgtaataattgtttacctcattaaatgaggttaaagatttggcgagtacgaagtgagcgatctagcgatgcgctgtaccctacctggattctttttcacagggtttgtgagtttttgtttcaacctgctaccttacaatatatatatatatatatatgcatcttctttatccc

SEQ ID NO: 46 - protein, 467 aa, Prunus persica
MRPQFTSPDAHSSSPALSSSSSSSSFSSSSDRRINALVRHLDSSAMDPNNNSSISASPTSAHANSVFAHVVRAPEDPILGVTVAYNKDPSPAKLNLGVGAYRTEEGKPLVLNVVRKAEQLLVNDRSRVKEYLPIVGLADFNKLSAKLILGADSPPIQENRITTVQCLSGTGSLRVGGEFLAKHYHERTIYIPQPTWGNHTKVFTLAGLSVKSYRYYDPATRGLDFQGLLEDLRSAPAGAIVLLHACAHNPTGVDPTLEQWEQIRQLVRSRGLLPFFDSAYQGFASGSLDADAESVRRFAADGGECLIAQSYAKNMGLYGERVGALSIVCKTADVASKVESQVKLVIRPMYSNPPIHGASIVATILKDRDLFNEWTIELKAMADRIISMRHQLFESLRAKGTPGDWSHIIKQIGMFTFTGLNSEQVAFMTKEYHIYMTSDGRISMAGLSSRTVPHLTEAIHAAVTRVA

SEQ ID NO: 47 - DNA, 1910 bp, Picea sitchensis
gagacccacccaacagcacgaatatccattcaaacactattattagctttgaggagaatgatggggaagaactcatcggcttgttcgtttgaggagaaggaaagcgataaaagtttaagtgtcgcgggtaggagaattggatcgcttgtgaggcaattagctgcaacttctatggaggggcaggcagatagagatggtgatcttcgttttcagccaactgcgggttctgcagtctctgcattccaacacttggaacaggctcctgaggatccaattcttggggtgacagttgcctataacaaggatccgagccctgtgaaattgaatttgggtgttggggcgtatcgaactgaggaaggaaaacctctcgtgctggatgttgtcaggcaagcagaggagctcttaattcaagacaggtctcgatataaggagtatattcctatagctggtcttgtagagttcaacaaactaagtgcgaagctgattcttggtgatggaagtcctgctattggggagaaaagggttgccactgcacaatgcttatctggaacaggttcactcagggttggagctgagtttctgtcaaagcattatagccaacacataatttatattccagtacccacatggggtaaccatcccaagatctttaatcttggaggattgagtgtgaagacatatcgctattatgatcccagaacaagtgggcttgattacgaaggtatgcttgaagatctacatgcagctcctcctggagctatagtgcttcttcatgcatgtgcacataatcctactggtgtagatcctacacaagaccaatgggaaggaattcggcaattaatcagattaaaaggtctgctgccattttttgacagtgcttatcagggatttgccagtggaagccttgatgcagatgcatactctgttcgtctgtttgtaggagatggtggtgaatgccttattgctcagagttttgcaaagaatatggggctgtatggggagcgtgtgggtgctcttagtattgtttgcaggagtgcaacagtggcaactagagttgaaagtcagttgaaattggttattcggccaatgtactcaagcccccctattcacggtgcttcgattgtggcaacaattctcagtgacaggaatctttattacaattggactgttgaattgaaaaacatggcagatcgcattattagtatgcgccatcagctctatgatgctctgaaggctcgtggaacccctggagactggagccacattattaagcagattggaatgttcacttttactggcctgaacaaagatcaagtttcatttatgactgcagaataccatatttatttgacttctgatgggcggataagtatggcaggtctgagctctaaaacagtcccacaccttgcagatgctatccatgctgctgttctccgccttggttagcagcatggttttccatacaataacttttgtgcataaaataaaacatgcaaggcctgaacttgcaaagcagattttcttgcaagaggcaaagagctgcagaattttttatcatatcatttgatttttcgtgcaattcatcaattaccgagacttggataattagtgcacatagcttctcttttcaaagtgataaactttgatattatgtagcaactcatccttttatcaaaatccctctttttactatttgctagtttatcgaccgaaatgatgttaatacaatcatgaaccaatatgcaatagttgcttaggatttttcttgtaaatcagatactgtcacatcagctggaggattataacttatagtacatgctcattgttctgctactatggattttttgcatgaaatactctacgagggaattatcctttgtattcattatattccgatacacagtttattg

SEQ ID NO: 48 - protein, 462 aa, Picea sitchensis
MMGKNSSACSFEEKESDKSLSVAGRRIGSLVRQLAATSMEGQADRDGDLRFQPTAGSAVSAFQHLEQAPEDPILGVTVAYNKDPSPVKLNLGVGAYRTEEGKPLVLDVVRQAEELLIQDRSRYKEYIPIAGLVEFNKLSAKLILGDGSPAIGEKRVATAQCLSGTGSLRVGAEFLSKHYSQHIIYIPVPTWGNHPKIFNLGGLSVKTYRYYDPRTSGLDYEGMLEDLHAAPPGAIVLLHACAHNPTGVDPTQDQWEGIRQLIRLKGLLPFFDSAYQGFASGSLDADAYSVRLFVGDGGECLIAQSFAKNMGLYGERVGALSIVCRSATVATRVESQLKLVIRPMYSSPPIHGASIVATILSDRNLYYNWTVELKNMADRIISMRHQLYDALKARGTPGDWSHIIKQIGMFTFTGLNKDQVSFMTAEYHIYLTSDGRISMAGLSSKTVPHLADAIHAAVLRLG

SEQ ID NO: 49 - DNA, 1769 bp, Populus trichocarpa
gaaagatgagaaacaactaccttcatctttcgccgcgtaagctataagaagccttctcatatctctctcttactagaagacaggatcccagaacagaacgcttcgaaatcaagaatttcaagaagccaaatcgagaaagctaaagaatttttcgacaaaaactgcaaagcaaaatgaacccagaattgacatcaccatcttcttctagtgatcgcagaattagcgtattagcaagacaccttgttggtgttgaaatggaccctcagaacgacagcatttcggcttttcctacttcaggttctgacagcaactctgttttctcccacgttgttcgcggtcctgaagaccccatcctcggtgtgactgttgcttataacaaagatcccagtcctgttaagctcaatttgggtgttggcgcttatagaactgaagaaggaaagcctcttgttttgaatgtagtgagaaaagctgagcagctgcttgttaatgacaggtcgcgagttaaggagtatcttcctattactggattggcagaattcaataaattgagtgctaagcttatgtttggtgccaactgccctgcaattcaagagaacagggttacaacagttcaatgcttgtctggcactggttcattgcgtgttggagctgaatttctggcaaaacaccatcatcaacggacaatatacattccccagccaacatggggaaaccaccctaaaattttcactttggcagggttatctgtcaaaacttaccgctattatgatccagcaacacgtgggctgaatttccaaggcctcgtggaagaccttaattctgccccatctggagctattgttcttcttcatgcctgtgctcataaccccacgggcgttgatccaacttctcagcagtgggagcagatcaggaagttgatgaggtcaaaagggttgatgcctttctttgatagtgcttatcagggttttgcaagcggaagtctggatgctgatgcacagcctgttcgcatgtttgttgctgatggcggtgaacttcttctagctcagagttatgcaaagaacatggggctatatggggagcgcattggtgctttgagcattgtttgcaagacagctgatgttgcaggcagggttgaaagccagttgaaacttgtgattagacccatgtattcaaacccacctattcatggtgcatctattgtggctgctattctaaaggacagggatttgtacaatgagtggaccatcgagttgaaggctatggctgaccgtataatcagcatgcgccagaaactctttgaagccttgcatgctagagggacacccggtgactggagtcacattgttaaacaaattggaatgtttacattcactggactgaactctaagcaagttgctttcatgactaaagagtaccacatctacatgacatcagatgggcggattagcatggctggtttgagctcaaagacagtccctcatcttgcagatgctatgcatgcagctgttaagcgagttgtgtagaagcaacaatcaggcactctaattacgaaaacctctctctgccatatcaaattggttgattgtctgttttttttttctgttttgccacaataattgtagtgcctacataaaatgggaaaaatgaaaacctttccataagaaaaagttcttggaataaacataattactacaggtgcattctttaatcaatgcacctttatctagcctccctcccttgaaatacaagtaaagatttattttgtcttc

SEQ ID NO: 50 - protein, 449 aa, Populus trichocarpa
MNPELTSPSSSSDRRISVLARHLVGVEMDPQNDSISAFPTSGSDSNSVFSHVVRGPEDPILGVTVAYNKDPSPVKLNLGVGAYRTEEGKPLVLNVVRKAEQLLVNDRSRVKEYLPITGLAEFNKLSAKLMFGANCPAIQENRVTTVQCLSGTGSLRVGAEFLAKHHHQRTIYIPQPTWGNHPKIFTLAGLSVKTYRYYDPATRGLNFQGLVEDLNSAPSGAIVLLHACAHNPTGVDPTSQQWEQIRKLMRSKGLMPFFDSAYQGFASGSLDADAQPVRMFVADGGELLLAQSYAKNMGLYGERIGALSIVCKTADVAGRVESQLKLVIRPMYSNPPIHGASIVAAILKDRDLYNEWTIELKAMADRIISMRQKLFEALHARGTPGDWSHIVKQIGMFTFTGLNSKQVAFMTKEYHIYMTSDGRISMAGLSSKTVPHLADAMHAAVKRVV

SEQ ID NO: 51 - DNA, 1556 bp, Poncirus trifoliata
ttctttgatttcttgaaagaaatttaatggattctgaatcagtgtttggaaagattgttcgtgctcctgaagatccgattctaggggtcactgttgcttataacaaggatacaagcccagtcaagttgaacttgggtgttggtgcttaccgaactgaggaagggaaacctctggttctgaatgtagtgagaaaggcagagcagctcttagtgaatgaccagtcacgggtcaaagagtatcttcccattgttggacttgcggattttaataaattgagtgcaaagctcatccttggtgctgacagccctgcgattaaagacaacagagtgaccaccgttcagtgcttgtctggcactggttctttgagggttggagctgagtttctggcaaggcattaccaccaacttaccatatatattccacagccaacatggggaaaccatcccaaagttttcactttagcaggattgtctgtgaagacctaccgctattatgatccagcaacacgtgggctaaacttccaaggcttgctggaggatcttagggctgcaccatcaggagctatagttcttcttcatgcatgtgctcataatccaactggtgttgacccgacccttgagcagtgggagcagatcaggcagctgatgaggtcaaaaggattgttacctttctttgacagtgcttatcagggttttgcaagtggtagcctagatgcagatgcacaatctgttcgcatgtttgtggcagatggtggtgaatgcctggtagctcagagttatgcgaaaaacatgggactctatggggaacgtgtcggcgccctcagcattgtctgcaagacagaagatgtggcaagcagggttgaaagccagttgaaactcgtgattaggcccatgtactctaatccacctattcacggtgcctctattgtggctacaattctcaaggacagcactatgtataaagagtggactcttgaactgaaagcgatggctgaccggattataagcatgcgtcagcaactatttgatgctctgtctgctagaggcactccaggagactggagtcacattatcaagcaaataggaatgtttacattcacagggctgaacagtgaacaagttgccttcatgaccaaggagtatcacatttatatgacatctgatgggaggattagcatggcaggtcttagttcaaagacagttcctcatcttacagatgctatacatgctgctgtaacccaaatgggctaaagattaatcagacaagaattcatgccgtaataattgtttgggtttcagtcatcctcagcaatgcaaaaatgagtttgtagaactagaaaatgcataaataaaggttttacattaagaaaattttgttcttttggttttggtgttgtattcttgtctttccaccaaaacttgacatgtttattaagcagaagaaaaacgaaagttgcgaggttatttatttttgcatttatctttggggagataccatttacatatttaactctccttgaaacgtttggtgactattttatagctggagttttagtt

SEQ ID NO: 52 - protein, 407 aa, Poncirus trifoliata
MDSESVFGKIVRAPEDPILGVTVAYNKDTSPVKLNLGVGAYRTEEGKPLVLNVVRKAEQLLVNDQSRVKEYLPIVGLADFNKLSAKLILGADSPAIKDNRVTTVQCLSGTGSLRVGAEFLARHYHQLTIYIPQPTWGNHPKVFTLAGLSVKTYRYYDPATRGLNFQGLLEDLRAAPSGAIVLLHACAHNPTGVDPTLEQWEQIRQLMRSKGLLPFFDSAYQGFASGSLDADAQSVRMFVADGGECLVAQSYAKNMGLYGERVGALSIVCKTEDVASRVESQLKLVIRPMYSNPPIHGASIVATILKDSTMYKEWTLELKAMADRIISMRQQLFDALSARGTPGDWSHIIKQIGMFTFTGLNSEQVAFMTKEYHIYMTSDGRISMAGLSSKTVPHLTDAIHAAVTQMG

SEQ ID NO: 53 - DNA, 1635 bp, Solanum lycopersicum
atcggccgaattgagagtaaacaaactttaaaaaggaaggcgtactgtagcaagcaaaagttccgtactactaaaatgcacacacaacaatcaccgtcaccctccgccgatcggaggttgagtgttctggcgaggcaccttgaaccgtcgtccgttgccgttgaaggtcatagcaaccactccattgtcggtgctcctacctcaggaaatgatggaaaacagtctgttttctctcatatcgttcgcgctcccgaagatcctattctcggcgttactgttgcatacaacaaagataccagccccatgaagttgaacttgggagttggtgcgtataggacagaggaaggaaaacctcttgttttgaatgttgttagacaagcagaacagctactagtaaatgataggtctcgcattaaagagtaccttccgatcactgggttggcagacttcaataaattgagtgctaagctgatacttggtgctgacagccctgctattcaagagaacagagtaacaactgtccagtgcttgtctggcacaggctcattgagagttgggggtgaatttttggctcaacactatcatcaacgtactatttatattccccaaccaacatggggaaaccacacaaaaattttcgctttagctgggttgtcagttaagagttaccgctactatgatccagcaacccgtggactccattttcaaggtttgttggaagaccttggatccgctccatcaggagcgatagtgttacttcacgcttgtgcacataaccccactggtgtggatccaaccaaagatcaatgggagcaaattaggagattgatgagatcaaaaggattgctacccttctttgatagtgcatatcagggctttgccagtggaagcctagatacagatgcacagtctgttcgcatgtttgtggcagatggaggtgaagtacttgttgctcaaagttatgcaaagaatatggggctttatggtgaacgtgtcggagctttaagcatagtgtgcagaaatgctgatgtaactagcagagttgagagccagttgaagttggtgattaggccaatgtattccaatccaccaattcacggtgcgtctatagttgctacaatcctcaaagacagaaacttgtaccatgaatggactcttgagttgaaagcgatggctgatcgaatcatcagaatgcgccagcaattatttgatgctttacgtgctaaaggtacccctggtgactggagtcacattatcaagcagattggaatgttcactttcacaggacttaacaaagaacaagtcgccttcatgaccaaagaataccacatctacatgacatcagatggacgcattagcatggcaggtctaagctccaggacagttccacacctgacagatgccatccatgctgctgtgactcgggctcgttgagttcactactggctactactgttttacatcatgttctctttaagttggccgagtatttcccgctcaagttaaaactcgattgcaattccccctccttgtaataactagtttcctctcctaagttggaggctataataaacctgtatctgtaatgtagaataaatatattttgcttaatgtagcaaaaccaattttcgttag

SEQ ID NO: 54 - protein, 452 aa, Solanum lycopersicum
MHTQQSPSPSADRRLSVLARHLEPSSVAVEGHSNHSIVGAPTSGNDGKQSVFSHIVRAPEDPILGVTVAYNKDTSPMKLNLGVGAYRTEEGKPLVLNVVRQAEQLLVNDRSRIKEYLPITGLADFNKLSAKLILGADSPAIQENRVTTVQCLSGTGSLRVGGEFLAQHYHQRTIYIPQPTWGNHTKIFALAGLSVKSYRYYDPATRGLHFQGLLEDLGSAPSGAIVLLHACAHNPTGVDPTKDQWEQIRRLMRSKGLLPFFDSAYQGFASGSLDTDAQSVRMFVADGGEVLVAQSYAKNMGLYGERVGALSIVCRNADVTSRVESQLKLVIRPMYSNPPIHGASIVATILKDRNLYHEWTLELKAMADRIIRMRQQLFDALRAKGTPGDWSHIIKQIGMFTFTGLNKEQVAFMTKEYHIYMTSDGRISMAGLSSRTVPHLTDAIHAAVTRAR

SEQ ID NO: 55 - DNA, 1659 bp, Saccharum officinarum
  misc_feature (1583)..(1583): n is a, c, g, or t
  misc_feature (1652)..(1652): n is a, c, g, or t
atttggttttctttgagcaccctgtgatggcagtcagttgcattctaaaaaaaaaaaaaaaaaccgttccccacgtcccccgatctcggttccctcgccccgcaccagcccgcaggcacgctcacgcgccgcgcaccggatggcccctgctatcgtgcgcgcggcgcaggcccccagcgccgaccgcaggttaagtacgctggtgcgccacctgctgccttcctccccacgaagaacagcagccgacacctccgccaccctcgaatcgttccccaccatggcgtcgcagggatcctcctccgtcttcgccgcactcgcgcaggccccggaggaccccatcctcggagtgaccgtcgcctacaacaaggatcccagccccgggaaggtcaacctcggcgtcggcgcctaccggaccgaggaagggaagcccctcgtgctgaatgtggtcaggcgcgccgagcaaatgttgatcaacaatccgtcacgtgtcaaggagtacctaccaatcactggtttggctgaattcaataagctgagcgctaagcttatctttggtgctgacagtcctgctattcaggagaatagggttgctacagtgcagtgcctatcgggtactggttctttaagagttggaggtgaatttcttgcaaggcactatcatgagcgcactatctacatcccgcaaccaacctggggaaatcacccgaaagtcttcaccttatctggattgactgttaggagctaccgctactatgatcctgcgacccgcggtcttgacttcaaaggactcttggaagacctcagttctgctccttcaggttcaattgtactgctgcatgcctgtgcccacaaccctactggagtagatcctaccattgatcagtgggaacagattaggcagctgatgagatcaaaatcactgcttccgttctttgacagtgcctaccaaggctttgcgagtggaagtcttgacaaagatgctcagtcagtgagaatgtttgttgctgatggtggtgaattgctcatggctcagagctacgctaagaacatgggattgtacggagagcgtgttggtgctttgagcattgtatgtggaagtgccgatgtagctgttagggttgaaagtcaactcaaacttgtgatcaggcctatgtattcaaacccccctcttcatggtgcctctatcgtggctaccatactcagggacagtgagatgttcaacgaatggactctagaactgaaggccatggctgataggatcattagcatgaggcaacagctatttgatgcgctgaaatccagaggaacccctggagattggagccacatcattaagcaaattgggatgtttactttcactgggctgaatagcgagcaagtggcattcatgaggcaggaataccacatttatatgacatccgatgggaggatcagcatggctggtttgagcatgaggactgtgccccatcttgcagatgccatacacgctgcagttactcaactgaaatgaggacagtatggcagctttcgtgaataaaatctgaatcacctactgtaatctgccttgaaataggagaatgttnttttactcttgtgttgaacagttttgactggcagattcaattcaaatattatggtcatatggtgcttcngaacctc

SEQ ID NO: 56 - protein, 456 aa, Saccharum officinarum
MAPAIVRAAQAPSADRRLSTLVRHLLPSSPRRTAADTSATLESFPTMASQGSSSVFAALAQAPEDPILGVTVAYNKDPSPGKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLTVRSYRYYDPATRGLDFKGLLEDLSSAPSGSIVLLHACAHNPTGVDPTIDQWEQIRQLMRSKSLLPFFDSAYQGFASGSLDKDAQSVRMFVADGGELLMAQSYAKNMGLYGERVGALSIVCGSADVAVRVESQLKLVIRPMYSNPPLHGASIVATILRDSEMFNEWTLELKAMADRIISMRQQLFDALKSRGTPGDWSHIIKQIGMFTFTGLNSEQVAFMRQEYHIYMTSDGRISMAGLSMRTVPHLADAIHAAVTQLK

SEQ ID NO: 57 - DNA, 1800 bp, Triticum aestivum
gcacgagccacgtccgcgcccctcgattccacagcaagcacccaacacgccgcacgcggcacgcgcccgagacgctcgtacgggccggcgcaccctagccgggccgcgatgcccacggctaacgtgcgcgcggcgcagcctggcgccgaccgcaggttaagtacgctggtgcgccacctgctgccttcttccccacgaacatcagcagcgaccgccacctccgccgactcctccctccaacctttccccaccatggcgtcgccctccgtcttcgccgggatcgcgcagggcccggaggaccccatcctcggggtgacggtcgcgtacaacaaggatcccagccccgtcaaggtcaacctcggcgtcggcgcctaccggaccgaggaagggaagcccctcgtgctgaatgtggtcaggcgcgccgagcagatgctgatccaaaacgagtcacgtgttaaggagtacttgccgatcactggattggccgatttcaacaagttgagtgctaagcttatcttcggtgctgacagtcctgctattcaggagaatagggtggctacagtgcagtgcttatcaggaactggttccctacgagtgggaggtgaatttcttgcaaggcactatcatgaacgcactatctacatcccccagccaacctgggggaatcacccaaaagtcttcactttagctggcctgactgctaggagttaccggtactatgatcctgcaactcgtggactggatttccaaggactcttagaagacctcagttcagctccctcaggcgcaattgtactgcttcatgcatgtgcccacaaccctactggtgtcgacccaaccttggaacagtgggaacagatcaggcagctgatgagatcaaaagcattgctgccattctttgacagtgcttatcaaggatttgcaagcggaagccttgacaaagatgcccaatcagtgcgcatgttcgtcgctgatggtggtgaattgctcatggctcaaagctacgccaagaacatgggattgtatggagagcgtgttggtgctttaagcatcgtttgtgggagtgctgatatagctgttaaggttgaaagtcaacttaagcttgtaattaggcctatgtattcgaaccctcctcttcatggtgcttctatcgtggctaccatacttaaggacagtgctatgttcgacgaatggactctggagctgaaggccatggctgataggataattagcatgagggagcagctttttaatgcgctgaaaatcagggaaacacctggagattggtcccacatcattaagcagattgggatgtttactttcactgggctcaacagtgatcaagtagccttcatgaggcaagaatatcacatttacatgacatctgatgggaggatcagcatggccggtttgagctccagaactgtaccccatcttgcagatgccatacatgccgcagtaacaaaactgaagtgaatgataacattgcaaccccctcgcacaataaaatcttgaattctctacagcagtttccgaggggttcaaccagaggtgtgttactggctgaactcgagaatttgccttgtagactcattaaacttgttgtctgagacagttttgtacacaccggattaaagattatggtgatttcgaatcccgaataagctgcagttgtgatgcttttcttacccttgaatgctgaggtatttatcctgcagcgctgtataatgcctagttttgggaagctaatgtttgtgagctgtatgtgcgttttcggttgttgcatacggtgcttttagt

SEQ ID NO: 58 - protein, 455 aa, Triticum aestivum
MPTANVRAAQPGADRRLSTLVRHLLPSSPRTSAATATSADSSLQPFPTMASPSVFAGIAQGPEDPILGVTVAYNKDPSPVKVNLGVGAYRTEEGKPLVLNVVRRAEQMLIQNESRVKEYLPITGLADFNKLSAKLIFGADSPAIQENRVATVQCLSGTGSLRVGGEFLARHYHERTIYIPQPTWGNHPKVFTLAGLTARSYRYYDPATRGLDFQGLLEDLSSAPSGAIVLLHACAHNPTGVDPTLEQWEQIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTLELKAMADRIISMREQLFNALKIRETPGDWSHIIKQIGMFTFTGLNSDQVAFMRQEYHIYMTSDGRISMAGLSSRTVPHLADAIHAAVTKLK

SEQ ID NO: 59 - DNA, 1810 bp, Volvox carteri
aggtcctttctcagtagcaaaagtaggcgtgcaacatcgccctcactatcgctctcgaaaaggagctgctatcttcgttttcgttccgtaattccctacctcgcgcagaatcatgagccctgaagaccgcatggaagtgctgacaaggcagttgtgtgcaggtcaatcgactgagagtaactgggagcatgtccagcaggcacccccagatcccattatcggtgtcacagatgcttggcgcgccgaccccgacccccgaaaacttaaccttggcgtgggagcctaccgaacggaggagggcaagccgtacgtcctgaaagccgtacgagaagcggagcagcagatccttgccgaccctgccatgaacaaggagtaccttccaatctccggcaaccctgagttcaaccgactggcccgcactctggccctcgggcctggcagctccgccatccagcagaaccgagtggccaccgtgcaggccttgtcgggcaccggcgcgctccgagttggtgctgagtttttgtcgatgcacttgcccgcctccataccgcgcatcgtgtatctgcccaatcccacctggggcaaccacaagagcatcttcgccaaggcgggattccaggttcgcgaatatcgctacttcgacgcggccactcgcggtctgaacttcgcgggtatggtggcggatgtgtcggcggcgcctcccggctcggtgctactactacacgcgtgtgcacacaaccccacgggtgtagatccctccccggagcagtggtctcggctgctggaggtggcacggtcgggaggactcgtgcccttctttgacatggcgtaccagggtttcgccagcggtgatctggatgcggatgcggcatctgttcggctgttcctggaggcaggtctggagctggtgctggctcagtcgttcgccaaaaacatggggttgtacggcgagcgcgccggcgctctcagcgtcgtgagcaagacaaaggaagttgccactcgagtggagtcgcagctcaagctcgtcgtgcggcccatgtactccaacccaccaatgcacggagctgccattgccgcacgcgtcatgggcgatcccaagctgaacgcgctgtggaaggaggagcttcgcggcatggccgagcgtatcaagtccatgcgccaggtgctgtacgaccaactggtggctcgcaacgtgccgggggattggagctttgtgctgaagcagattggcatgttcagctttacagggatgacgcggcaccagtgcgagcagctggtcagcaagtggcacgtgcacctcactctggacggcaggatttcgatggcgggattgtcagcggcaaccgcgccctatctggcagaggccattgcggacgtaattcagaacgcttagataaagatggtaaaatgaggggtgctgcgcgatgttgccatggtggttgaggacgcggcgggagaggatgcgctaggtggcgccctgccatcggttggcactctggtcgttcggtttatgatttgggtacgtgccgtgggcaagcaaacattttgttcgtttgcggtccttgtcatgcccgaccagcagtcgttaaatatttattttctttgcttgtcacgatagcgcgatatgtctctttagtctagaaccccctgtcttgcgtttggaaatgtcgtgcaatagaacacgttccttcattacccggtgcgagacgcgtgcgagactgtaccgggaaagaacgggtttgtgtcactgttgcgacatatagtcacggatgccgttttaaattactaaagttgtaatgcagtgtagtac

SEQ ID NO: 60 - protein, 426 aa, Volvox carteri
MSPEDRMEVLTRQLCAGQSTESNWEHVQQAPPDPIIGVTDAWRADPDPRKLNLGVGAYRTEEGKPYVLKAVREAEQQILADPAMNKEYLPISGNPEFNRLARTLALGPGSSAIQQNRVATVQALSGTGALRVGAEFLSMHLPASIPRIVYLPNPTWGNHKSIFAKAGFQVREYRYFDAATRGLNFAGMVADVSAAPPGSVLLLHACAHNPTGVDPSPEQWSRLLEVARSGGLVPFFDMAYQGFASGDLDADAASVRLFLEAGLELVLAQSFAKNMGLYGERAGALSVVSKTKEVATRVESQLKLVVRPMYSNPPMHGAAIAARVMGDPKLNALWKEELRGMAERIKSMRQVLYDQLVARNVPGDWSFVLKQIGMFSFTGMTRHQCEQLVSKWHVHLTLDGRISMAGLSAATAPYLAEAIADVIQNA

SEQ ID NO: 61 - DNA, 1236 bp, Vitis vinifera
atgaattctcagcacccagatggctctgtcttctccaacatcgttcgtgctcctgaggatcccattcttggggtcactgttgcttataacaaggataccagcccaatcaagttgaatttgggtgtgggtgcttatcgaacagaggaaggaaaaccccttgttttgaatgtagtgagacgagccgaacagctgttggttaatgacccgtcccgggtcaaagagtaccttcccattgttggactggcagagttcaataaattgagcgctaaactcatttttggtgctgacagcccggctatccaagaaaatagagtagctactgtccagggtttgtctggtactggttcactgagaattggagctgagtttctggcaaggcattactaccagcatacaatttacattccagtgccaacatggggaaaccatccaaaaattttcaccatagcggggttgtctgtgaagacttaccgctactatgacccagaaacacgtgggctagacttcaaaggactgttggaggaccttggtgcagcgccaacaggagcaattgtgcttcttcatgcatgtgctcataaccccactggtgttgatccaactcttgagcagtgggagcagatcagacagttgatgagatcaaaagggttgttacctttttttgacagtgcttatcagggatttgcaagtggtagtttggatgcagatgcccagtctgttcgaatgtttgttgcagatggtggtgaatgccttgcagctcagagttatgcaaaaaacatgggactctatggggaacgtgttggtgcccttagcattgtctgcaaggcagcagacgtggcaagcagggttgagagccagctgaaacttgtgatcaggcccatgtattccaatccccctattcatggtgcatctattgtggctacaatcctcaaggacagtgatatgtataatgaatggactctggagctaaaagcaatggcggaccggattatcagcatgcgtcaactactgtttgatactttacgtgatagaggcacccctggcgactggagtcacattataaagcaaattggaatgttcactttcacagggctgaatactgagcaagtcgccttcatgaccaaggaatatcacatctacatgacatctgatgggaggattagtatggccggccttagttcgaggacggtccctcaccttgctgatgctatacatgctgctgttacccgaattccctag

SEQ ID NO: 62 - protein, 411 aa, Vitis vinifera
MNSQHPDGSVFSNIVRAPEDPILGVTVAYNKDTSPIKLNLGVGAYRTEEGKPLVLNVVRRAEQLLVNDPSRVKEYLPIVGLAEFNKLSAKLIFGADSPAIQENRVATVQGLSGTGSLRIGAEFLARHYYQHTIYIPVPTWGNHPKIFTIAGLSVKTYRYYDPETRGLDFKGLLEDLGAAPTGAIVLLHACAHNPTGVDPTLEQWEQIRQLMRSKGLLPFFDSAYQGFASGSLDADAQSVRMFVADGGECLAAQSYAKNMGLYGERVGALSIVCKAADVASRVESQLKLVIRPMYSNPPIHGASIVATILKDSDMYNEWTLELKAMADRIISMRQLLFDTLRDRGTPGDWSHIIKQIGMFTFTGLNTEQVAFMTKEYHIYMTSDGRISMAGLSSRTVPHLADAIHAAVTRIP

SEQ ID NO: 63 - DNA, 1353 bp, Vitis vinifera
atgtaccagcaattctcttcacccgccgatcggaggttgagtgctctggcccggcacctggagggctcgtccccatcgtccaccatggaccctaaccacacgatctctgcttctgcaacctcgggctccgatttcggtggctctgtttttgatcacgtcgttcaggctcctgaagatcccattctaggggtgactgtggcctacaacaaagatcctagcccagtgaaactgaacttgggcgttggtgcttatcgaacagaggaaggaaagcctcttgttctgaatgtagtgagacgggcagagcagctgcttgttaatgacaggtcccgggtcaaagaatatcttcctattgttgggctggcagaattcaataaattgagtgctaagctcatgtttggcgctgacagccctgctattcaggtgaagagggttactactgtccagtgtttgtctggtaccggctcattgagagttggagctgagtttttggcgagacatcatcaccaacgaaccatatacattccacaaccaacatggggaaaccatggaaaaattttcacattagcagggttatctgtgaagacttaccgctattatgatccagcaacacgtgggctgaacttccaaggcttgttggaagaccttagtcttgccccttctggagcaattgtgcttcttcatgcatgcgctcacaaccccactggtgtcgacccaacccttcagcaatgggagcagataaggcagttgataagattgaaagggttgttacctttctttgacagtgcttaccagggttttgcaagtgggagtctggatgcagatgcgcagtctgttcgcatgtttgttgctgatggtggtgaatgccttgctgctcagagttatgccaagaacatggggctctacggggaacgtgttggtgcactgagcattgtttgcaagacggcggatgtggcaagcagggttgagagccaggttaaacttgtgatcaggcctatgttttcaaacccacccattcatggtgcatctatcgttgcaatcatcctgaaaaacagggatatgtacaatgaatggactgttgagttgaaggcaatggcagatcgtattatcagcatgcgccagcaactctttgatgctttacgggccagaggcacaccaggtgactggaatcacattctcaagcagattggaatgtttactttcacaggattgaacaccgctcaagtggccttcatgaccaaagagtaccacgtctacatgacatctgatgggaggatcagcatggcaggtctgagctccaagacagtccctcatcttgcagatgctatacatgccgccgtcacccgtgctatctaa

SEQ ID NO: 64 - protein, 450 aa, Vitis vinifera
MYQQFSSPADRRLSALARHLEGSSPSSTMDPNHTISASATSGSDFGGSVFDHVVQAPEDPILGVTVAYNKDPSPVKLNLGVGAYRTEEGKPLVLNVVRRAEQLLVNDRSRVKEYLPIVGLAEFNKLSAKLMFGADSPAIQVKRVTTVQCLSGTGSLRVGAEFLARHHHQRTIYIPQPTWGNHGKIFTLAGLSVKTYRYYDPATRGLNFQGLLEDLSLAPSGAIVLLHACAHNPTGVDPTLQQWEQIRQLIRLKGLLPFFDSAYQGFASGSLDADAQSVRMFVADGGECLAAQSYAKNMGLYGERVGALSIVCKTADVASRVESQVKLVIRPMFSNPPIHGASIVAIILKNRDMYNEWTVELKAMADRIISMRQQLFDALRARGTPGDWNHILKQIGMFTFTGLNTAQVAFMTKEYHVYMTSDGRISMAGLSSKTVPHLADAIHAAVTRAI

SEQ ID NO: 65 - DNA, 1839 bp, Zea mays
acccggcttgcgcacgccgttcacgtcccccggcccccgctctcgtttcccccgcccgcaccaggcacgctcacgcgctgcgcaccggatggcccctgctaacgtgcgcgcggcgcaggcgcaggcccccagcgccgaccgcaggttaagtacgctagtggggcacctgctgccttcctccccacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagctaccgctattatgatcctgcaacatgcagccttcacttcgaaggactcctggaagacctcggttctgctccttcaggttcaattgtactgctgcatgcctgtgctcacaaccctactggagtagatcctaccatcgaacagtgggaacagattaggcagctgatgagatcaaaatcactgcttccgttctttgacagtgcctatcaaggctttgcaagtggaagtcttgacaaagatgctcagtcagtgcgtatgtttgttgctgatggtggtgaacttctcatggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcagccagtggtatttactggttgacctactgtagtttgcgtcggaatagatatgtttttttactcttcgtggggcagttttgtactggtggattcataaggactctgattatggtgcgttcggaacttataataataagcacatgaaattttgcttcaggtgcagtgatgctgtctcattaagttattagttattaggttgctgtcttattaagttatcaggtcgcagctgggttgaagcggagcacctagtcttgatttatctcttctcttttctagagagcttctgtcattcgtgttgccctttttaa

SEQ ID NO: 66 - protein, 459 aa, Zea mays
MAPANVRAAQAQAPSADRRLSTLVGHLLPSSPRRAAADTSATSTLESFPTMASQGSSVFAALEQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLLEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCKSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 67 - DNA, 2241 bp, Chlamydomonas reinhardtii
tcgatactgtgatcttgaattccttgaacagtccatctcgttagacgccaacaacaatgcagctccaggcgcgcatgcaattgcgttcggccggcccccgccgcgccgggcccgtgccggtccgcgccatggcgggcagccgcttcgctgacgtggcgcaggcgccgcccgaccccatcctgggcgtgagcgaggcgttcaaggcctccaccgaccccaacaagctcaacctgggcgtgggcgcctaccgcgacgagcagcttaagcccgtggtgctcagcgtggtcaagaaggcggagtcgaagatcttctcccgcaacgagaacaaggagtacctgaccattgagggcctggacgccttccgcaaggccaccgtggacctgttgctgggcggagaccaccccgccatcaaggagggccgtgtggctgtggtgcagtcgctgtcgggcacgggcagcctgcgtgtgggcgcggccttcattgcgcgcttcatgaagggcgccaccgtctacctgtccaaccccacctggggcaaccaccgcaacatctttggcgacgagggcgtggagtggaagtactaccgctactttgacgccgacacggtgggcctggacttccgcggcatggtgcaggacctgcaggccgcgccgcccggctccgtggtggtgctgcacggctgcgcgcacaaccccactggtattgaccccaccaaggaccagtgggcggccattgcggacctgtgcaaggagcgcaacctcatgcccttctttgacgtggcgtaccagggctttgccaccggcgacctggacaaggacgcctacgcgccgcgcctgtttgtggagaaggggctggagattgtggtgtcgcagtcctactccaagaacctggggctgtacggcgagcgcgtgggggcgctggtcatggtgctcaacgacaaggaggccgccacccgctgcctgagccagctgaagcgcctggcccgtgcgctgtactccaacccgcccacccacggcgcgcgcatcgccgccgaggtggtgaacgacaaggagctgttcgaggagtggaagggcgagatgcgcggcatggccggccgcatcgagcgtgtgcgcggcgagctgcagcgttcgctggagagcaagtaccccagcaaggactggagcttcatcaccaagcagatcggcatgttcagcttcaccggcctcacgcctgcacaggtggacaacatgaccaacaagcatgccatcttcatgacccgcgacggccgcatcagcctggccggcctcaacagcgccaaggtggactacctggcggaggccattgtggacagcgtgcgcaaccactagaggaggcggacaccaggtgatattggaggtgatactggaggtgctaaggggtgctatgaagtgctgggtgtaggtcaggcgggaaagcggcgcgcagcacgcgcggcgcttgaatggagcctgcgaggcaagcggcgaggagcgccagtggcaaggctctggcggcagcggcaggccttcgatgcctgaatatgtagtgctagagcagtgctggaggcagcaggggagcacggacatttggcctaagggctgatgcatttgtccaggcgtgaggcgtggctatcggacacggactgcctatcttgctgggagtctcgggctagggccgcacctactggacgcggcttcccctcccaagagcacgtttcctcgccaagaggaagcgttgtggggcggcctttgtaccatgatttgtcgtgcgggcaagaaccataaagaataagtggtgggtggcggatgggcagcagtcggatttcggtgtggagcaagaacgccggacacacgtctggagggcacgattcgtgagtgacgttggtatgctgcacggacatattaactaagggatatgaccacgagcctggattcaaactacggtgtagacgctgtggatgtgcaaggattcggtgcagcgagcactggttggggttgtgaagtgcgggctgcacgcaacatggcgcaactgttgccggcctgggctccgcatgttgctagcatggagcaggtgtcaacattaagtgtgcttgcaaacgatgattgctgccatagctgcagatggcaagagtcacgttaggtgggtggcggggagcggcacagggggcccgcgggggtaaacgcctgcaaggagcacctggtccacataaagcgttgcaacagcccaaatgcagacatgttatttgaa

SEQ ID NO: 68 - protein, 428 aa, Chlamydomonas reinhardtii
MQLQARMQLRSAGPRRAGPVPVRAMAGSRFADVAQAPPDPILGVSEAFKASTDPNKLNLGVGAYRDEQLKPVVLSVVKKAESKIFSRNENKEYLTIEGLDAFRKATVDLLLGGDHPAIKEGRVAVVQSLSGTGSLRVGAAFIARFMKGATVYLSNPTWGNHRNIFGDEGVEWKYYRYFDADTVGLDFRGMVQDLQAAPPGSVVVLHGCAHNPTGIDPTKDQWAAIADLCKERNLMPFFDVAYQGFATGDLDKDAYAPRLFVEKGLEIVVSQSYSKNLGLYGERVGALVMVLNDKEAATRCLSQLKRLARALYSNPPTHGARIAAEVVNDKELFEEWKGEMRGMAGRIERVRGELQRSLESKYPSKDWSFITKQIGMFSFTGLTPAQVDNMTNKHAIFMTRDGRISLAGLNSAKVDYLAEAIVDSVRNH

SEQ ID NO: 69 - DNA, 1691 bp, Centaurea Solstitialis
tacatcttctacatcatcatattgcatcgtccatagtcaaactcactctccgttccctcagtcttgacacgtccacacatggacttcagccttgatatccttcccataagtctttatttccgcagccatgtctttgcaaaacaagtgcaaggacacaatgaactctgaaaactccttccaaagtgccttctttggaaaggaaaaaggacccctctctacgaaaacaaagtctcacggtcggataacgatggctgtagctgtcaatgcttcacgatttgataacattacaatggctcctccagatcctattcttggagtttctgaagcattcaaagctgacacagatgaaatgaagctcaaccttggtgttggagcatatcgtacggaagaacttcagccctatgtgctcaaagttgtcagaaaggctgaaaatcttatgctggaaaggggagaaaacaaggagtatcttcctatcgaaggtttggcttcattcaacaaagccacagctgagttgttgtttggagcagataatccagtccttcatgaacagagagttgccaccattcaaggtctctcaggcactggctcccttcgaattgctgcggcactaattgagagatacttccctggagcaaaagttataatatcatctccaacttggggaaatcacaagaatattttcaatgatgctaaagttccttggtccgagtatcggtactatgatccaaaaacagttggcctagattttgatgggatgattgcggacataaaagctgctcccgaaggatccttcgtgcttcctcatggctgtgctcacaatccaacaggcattgatccaacccctgaacagtgggagaaaattgctgatgtcattcaagagaaaaaccatattccattcttcgatgttgcttatcagggatttgccagtggaagcctagaccaagatgcatcgtctgtgaggttgtttgctgcccgtggaatggagcttttagttgcacaatcatatagtaaaaatctaggtctatatgccgagagggttggagcaattaatgtactatgctcatcagccgatgcagctgtgagggtgaagagccagatgaaaagaattgccaggccaatgtactcaaacccaccggttcatggggcacggatcgttgctaatgttgtagggaacccagatttctttaacgagtggagagcggaaatggaaatgatggcgggaaggatcaaaagcgtgagacaaaagctatacgataacctctgtgctaaggataagagcggaaaagactggtcttttgttcttaagcagattggcatgttttcttttaccggtctcaacaaagctcagagcgataacatgactgataaatggcacatttacatgacaaaagatggaagaatatcgttggctggtttatctgctgcaaaatgcgagtatcttgccgatgccatcattgattcctaccacaatgtgagctagaaactgcataacttatcattaaaaaccatcaataatttgaatgagagatgaggcttgttcattctagatataattttgcagaaatgttgtaactttcttttttggtagaaaacccttgtagctgaataaaatttacatacaagccctgtttgcttccctttgggttcgggaagaaggcatatgttaagctaccataattatgattttttgc

SEQ ID NO: 70 - protein, 450 aa, Centaurea Solstitialis
MSLQNKCKDTMNSENSFQSAFFGKEKGPLSTKTKSHGRITMAVAVNASRFDNITMAPPDPILGVSEAFKADTDEMKLNLGVGAYRTEELQPYVLKVVRKAENLMLERGENKEYLPIEGLASFNKATAELLFGADNPVLHEQRVATIQGLSGTGSLRIAAALIERYFPGAKVIISSPTWGNHKNIFNDAKVPWSEYRYYDPKTVGLDFDGMIADIKAAPEGSFVLPHGCAHNPTGIDPTPEQWEKIADVIQEKNHIPFFDVAYQGFASGSLDQDASSVRLFAARGMELLVAQSYSKNLGLYAERVGAINVLCSSADAAVRVKSQMKRIARPMYSNPPVHGARIVANVVGNPDFFNEWRAEMEMMAGRIKSVRQKLYDNLCAKDKSGKDWSFVLKQIGMFSFTGLNKAQSDNMTDKWHIYMTKDGRISLAGLSAAKCEYLADAIIDSYHNVS

SEQ ID NO: 71 - DNA, 1686 bp, Carthamus tinctorius
gcgggggctctcgattgcatcgctcacccactcttcttcttcatcatcttcatcgccatagtcaaaatcacactccttctctccgtcggaacttcacagatggcttcggcattgctttctttcccatcagtctctacgtctgctgccctgtctttgcaagacaagtgcaaggacaaaatgaagtctggaagctctttccaaagtgccttctttggaaaggaaaaacaacccctctctatgaaaacgaagtctcatggtcgtataacgatggctgtagctgtcaatgcttcacgatttgatagcattacaatggctcctcccgatcctattcttggagtttctgaagcattcaaagctgacacagatgaaatgaagctcaaccttggtgttggagcatatcgtacagaagaacttcagccctatgtgctcaaagttgttagaaaggctgaaaatcttatgctggaaaggggagaaaacaaggagtatcttcctatcgaaggtttggcatcattcaacaaagccacagctgagttgttgtttggagcagataatccagtccttcatgaacagagagttgccaccattcaaggtctctcaggcactggctcccttcgaattgctgcggctctaattgagagatacttccctggagcaaaagttctaatatcatctccaacttggggcaatcacaagaatattttcaatgatgctagagttccttggtctgagtatcggtactatgatccaaaaacagttggcctagattttgatgggatgattgctgacataaaagctgctccagaaggatccttcgtgcttcttcatggctgtgctcacaatccaacaggcattgatccaactcctgaacagtgggagaaaattgctgatgtcattcaagagaaaaaccatattccattcttcgatgttgcttatcagggttttgctagtggaagcctagaccaagatgcatcgtctgtgaggttgtttgctgcccgtggaatggagcttttagttgcacagtcatatagtaaaaatctaggtctttacgccgagagggttggagcaattaatgtcctatgctcatcagccgatgcagctgtgagggtgaagagccagatgaaaagaattgccaggccaatgtactcaaacccaccggttcatggggcacggatcgttgctaatgttgtagggaacccagatttctttaacgagtggagagaggaaatggaaatgatggcgggaaggatcaaaagcgtgagacaaaagctatacgataacctctgtgccaaggataagagcggaaaagactggtcttttgttcttaagcagattggcatgttttcttttactggtctcaacaaagctcagagcgataacatgactgataaatggcacatttacatgacaaaagacggaagaatatcattggccggtttatctgctgcaaaatgcgagtatcttgccgatgccatcattgattcgtaccacaatgtgagctagaaaaaaacaatctttaaaaagcatcaataatttgaatgagatgtgaggcttatttattctggacataattttgcagaaatgttgtaacttttttgttggtagaaaacccttgtagctgaataaaatttacatacaaaccctgtttgcctccctttttgttggggaaggcatatgttggttgccatg

SEQ ID NO: 72 - protein, 466 aa, Carthamus tinctorius
MASALLSFPSVSTSAALSLQDKCKDKMKSGSSFQSAFFGKEKQPLSMKTKSHGRITMAVAVNASRFDSITMAPPDPILGVSEAFKADTDEMKLNLGVGAYRTEELQPYVLKVVRKAENLMLERGENKEYLPIEGLASFNKATAELLFGADNPVLHEQRVATIQGLSGTGSLRIAAALIERYFPGAKVLISSPTWGNHKNIFNDARVPWSEYRYYDPKTVGLDFDGMIADIKAAPEGSFVLLHGCAHNPTGIDPTPEQWEKIADVIQEKNHIPFFDVAYQGFASGSLDQDASSVRLFAARGMELLVAQSYSKNLGLYAERVGAINVLCSSADAAVRVKSQMKRIARPMYSNPPVHGARIVANVVGNPDFFNEWREEMEMMAGRIKSVRQKLYDNLCAKDKSGKDWSFVLKQIGMFSFTGLNKAQSDNMTDKWHIYMTKDGRISLAGLSAAKCEYLADAIIDSYHNVS

SEQ ID NO: 73 - DNA, 1985 bp, Gossypium hirsutum
gttatggacactcatcaacacaacatcggacacgatcgtgaatcatgaaccctaaagatcttaatcaacgtcaactaatggtaaagccgcttatgagctgaaaagtggcaaacgactatacccctaaagacgatttcatcacagtgcacacacacagtctctaccagctcgatcccaacggcagagcatttcacagtgttttggctgaaaaaatcaaaaacccattttgatcgccaacaccaccaccaaagttttcgccttgatcccatcgcccccttttgcctctactaaaccccttatctctaatccttgctattaccaatttgttgatttcattatggcttccacactgctctctttggcttctgccactccctctgcttcactttgttttcatgaaattaacaagggaaaattgaatcttgggtgcatcaacaaggaaaaaaccaatcctttcatcaaagcaaagtcttttggtcgagtctctatggttgtggcttccaatgtgtctcatttcgagggtattacaatggctccccctgatccaattcttggggtgtctgaagctttcaaagcagacgaccatgagttgaaactcaaccttggtgttggagcctatagaactgaagagctacagccttatgtgcttgatgtggttaaaaaggcagataagcttctactcgagaaaggggaaaacctagagtatctcccaattgaaggcttggctgctttcaataaagtgacggcggagttgttatttggagcggacaatccagttataaagcaacaaagggttgcaacggttcaagggctttcgggaaccggttcacttcggctggctgcagctctcatagaacgatattttcccggggcaaaagttctaatatcatctcctacatggggtaaccacaagaacattttcaacgatgctagggttccatggtcggaataccgatattacgacccgaaaacagttggtttggattttgaagggatgatagcggacatcaaggcagctcctgagggatcttttattcttcttcatggttgcgctcacaacccaactggtatcgatccaactcctgaacagtggggagtaattgcagatgttatccaagagaagaaccatattccatttttcgatattgcataccaggggtttgcaagtggaagcctggacaccgatgcagcgtctgtgaggatgttcgtggcccgcggtatggaggttattgctgctcaatcatacagtaaaaatctcggcctatatgcagaaaggattggagcaatcaatgttgtttgctcatcaccagaggcagctgcaagggtaaagagccaactgaaaagaatagctcgaccaatgtactcgaatcctcctgttcatggggcaagaattgtcgccaacattgttggggattcagctctcttcaaggaatggaatgctgagatggaaatgatggcagggagaatcaagaatgtgagacataaattgtttgatagtctttcttccaaagataaaagtgggaaggattggtctttcgttcttaagcagatcgggatgttttcgttcacaggcttaaacaaagctcagtgcgataatatgacaaacaagtggcatgtttatatgaccaaggatggaaggatatcacttgcaggattatctttggctaagtgtgaatatctagcagacgccatcattgactcataccacaatgtgagttaacaagataatgaaaaattttactaaaaaaaacatgttgtaataatgtgtttaaactgagcattaaaagaactcttgaatttagagatttgatggaggctggtttttgctgcctcttccttttaattttgctcaaagtgggggaattttgaagttctattgattgtatgacaataaatcatttatgaagtaactgaaaactaggggattagctatatctatatatttatttatttattttaagtgttttattgagttgatgtcattg

SEQ ID NO: 74 - protein, 460 aa, Gossypium hirsutum
MASTLLSLASATPSASLCFHEINKGKLNLGCINKEKTNPFIKAKSFGRVSMVVASNVSHFEGITMAPPDPILGVSEAFKADDHELKLNLGVGAYRTEELQPYVLDVVKKADKLLLEKGENLEYLPIEGLAAFNKVTAELLFGADNPVIKQQRVATVQGLSGTGSLRLAAALIERYFPGAKVLISSPTWGNHKNIFNDARVPWSEYRYYDPKTVGLDFEGMIADIKAAPEGSFILLHGCAHNPTGIDPTPEQWGVIADVIQEKNHIPFFDIAYQGFASGSLDTDAASVRMFVARGMEVIAAQSYSKNLGLYAERIGAINVVCSSPEAAARVKSQLKRIARPMYSNPPVHGARIVANIVGDSALFKEWNAEMEMMAGRIKNVRHKLFDSLSSKDKSGKDWSFVLKQIGMFSFTGLNKAQCDNMTNKWHVYMTKDGRISLAGLSLAKCEYLADAIIDSYHNVS

SEQ ID NO: 75 - DNA, 1754 bp, Glycine max
gtttccttcatcttcttcttcttcttctatctctctacaacacacttttttaagtgattcgttcgcagaaacatggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgttaagaaggcagagaatcttatgctggagagaggggataacaaagagtatctcccaattgagggtttggcagcatttaataaggcaactgcagagttgttactcggagcagacaacccagcaatcaaacagcaaagagttgccactgtccaaggtctttctggaactggttctctgcgactaggtgcagctctgatagagcgatattttcctggggcaaaagttttgatatcagctcctacctggggtaatcacaagaatattttcaatgatgctagtgtcccatggtctgagtaccgatattatgatcccaagacagttgggttggattttgagggcatgattgaagatataaagtcagctccggaaggatcttttatcttacttcatggatgtgctcataatcctactggtattgatccaacacctgaacagtgggaaaaaatagctgatttaattgaagaaaagaaccacattcccttttttgatgttgcttaccaggggtttgctagtggaagccttgatgaagatgcagcttctgtgagactgtttgtggcacgtggcatcgaggttcttgtagctcaatcttacagtaaaaatctcggtctctatgctgaaaggattggagcaatcaatgtgatttcatcgtcaccagaatctgcagcaagggtaaagagccaactgaaaaggattgcccgaccaatgtactctaatccaccggtacacggggctaggatagttgccgatgttgttggaaacccagttctctttaatgaatggaaagcagagatggaaatgatggctggaaggataaagaatgttagacagcagctatatgatagtattacttcaaaagacaaaagtggaaaggattggtcattcatacttaagcagataggcatgttctcattcactggcttgaacaagaaccagagtgacaacatgacaaacaagtggcacgtatacatgacaaaggatggaaggatttccctggcaggattgtcgttggctaaatgcgaataccttgcggatgctattattgattcatatcataatgtcagctgaaactcaattagatatttttggtgagtgttatacccaatcggagcgattggcatacatgaaaataatttagaataatttatgtatgcattatgtgtgtacatatgtacctcaaagtaccctaggaaattttttttaactttgaaacaagttgactcaaagtattgatgcgtaatgagtcaggttctcagacttaaagctagttgaatcgaagtactgatgcatagtgaggatgtttatcatttcatatgggtgagattggataaatcatggtaacaatagtttcgttaaaa

SEQ ID NO: 76 - protein, 463 aa, Glycine max
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAERIGAINVISSSPESAARVKSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISLAGLSLAKCEYLADAIIDSYHNVS

SEQ ID NO: 77 - DNA, 1841 bp, Gossypium raimondii
  misc_feature (60)..(60): n is a, c, g, or t
ctgaaaagtggcaaacgactatacccctaaagacgatttcatcacagtgcacacacacangtctctaccagctcgatcccaacggcagatcatttcacagtgttttggctgaaaaaatcaaaaacccatttcgatcgccaacaccaccaccaaagttttcgctttgatcccatcgcccccttctgcctctactaaaccccttatctctaatccttgctattaccaattgttgatttcattatggcttccacactgctctctttggcttctgccactccctctgcttcactttcttttcatgaaattaacaagggaaaattgaatcttgggtgcatcaacaaggaaaaacccaatcctttcatcaaagcaaagtcttttggtcgagtctctatggttgtggcttccaatgtgtctcatttcgagggtattacaatggctccccctgatccaattcttggggtgtctgaagctttcaaagcagacgaccatgagttgaaactcaaccttggtgttggagcctatagaactgaagagctacagccttatgtgcttgatgtggttaaaaaggcagataagcttctactcgagaaaggggaaaacctagagtatctcccaattgaaggcttggctgctttcaataaagtgacggcggagttgttatttggagcggacaatccagttataaagcaacaaagggttgcaacagttcaagggctttcgggaaccggttcacttcggctggctgcagctctcatagaacgatattttcccggggcaaaagttctaatatcatctcctacatggggtaaccacaagaacattttcaacgatgctagggttccatggtcggaataccgatattacgacccgaaaacagttggtttggattttgaagggatgatagcggacatcaaggcagctcctgagggatcttttattcttcttcatggttgcgctcacaacccaactggtatcgatccaactcctgaacagtggggagtaattgcagatgttatccaagagaagaaccatattccatttttcgatattgcataccaggggtttgcaagtggaagcctggacaccgatgcagcgtctgtgaggatgttcgtggcccgtggtatggaggttattgctgctcaatcatacagtaaaaatctcggcctatatgcagaaaggattggagcaatcaatgttgtttgctcatcaccagaggcagctgcaagggtaaagagccaactgaaaagaatagctcgaccaatgtactcgaatcctcctgttcatggggcaagaattgtcgccaacattgttggggattcagctctcttcaaggaatggaatgctgagatggaaatgatggcagggagaatcaagaatgtgagacataaattgtttgatagtctttcttccaaagataaaagtgggaaggattggtctttcgtttttaagcagatcgggatgttttcgttcacaggcttaaacaaagctcagtgcgataatatgacaaacaagtggcatgtttatatgaccaaggatggaaggatatcccttgcaggattatctttggctaagtgtgaatatttagcagacgccatcattgactcataccccaatgtgagttaacaagataatgaaaaattttactaaaaaaaacatgttgtaataatgtgtttaaactgaccattaaaagaactcttgaatttagagatttgatggaggctggtttttgctccctcttccttttaattttgctcaaagtgggggaattttgaagttctattgattgtatgccaataaatcatttatgaagtaactgaaaactaggggattaactatatcta

SEQ ID NO: 78 - protein, 460 aa, Gossypium raimondii
MASTLLSLASATPSASLSFHEINKGKLNLGCINKEKPNPFIKAKSFGRVSMVVASNVSHFEGITMAPPDPILGVSEAFKADDHELKLNLGVGAYRTEELQPYVLDVVKKADKLLLEKGENLEYLPIEGLAAFNKVTAELLFGADNPVIKQQRVATVQGLSGTGSLRLAAALIERYFPGAKVLISSPTWGNHKNIFNDARVPWSEYRYYDPKTVGLDFEGMIADIKAAPEGSFILLHGCAHNPTGIDPTPEQWGVIADVIQEKNHIPFFDIAYQGFASGSLDTDAASVRMFVARGMEVIAAQSYSKNLGLYAERIGAINVVCSSPEAAARVKSQLKRIARPMYSNPPVHGARIVANIVGDSALFKEWNAEMEMMAGRIKNVRHKLFDSLSSKDKSGKDWSFVFKQIGMFSFTGLNKAQCDNMTNKWHVYMTKDGRISLAGLSLAKCEYLADAIIDSYPNVS

SEQ ID NO: 79 - DNA, 1565 bp, Helianthus exilis
ctcactcaatcttcttcttcttcttcatcgccacccccaaaatcactctaaactcacagatggcttcgattcccctctcatcaatctgtccttcggctgctttgtcattccgagagaagtgcaaggacaaaacgaagtcaaatgttttgttcgggaaggaaaaacaacccctctatatgaaaacaaagtctcgtggtcgaataaccatggctgtagctgtcaacacttcacgattcgataatataacaatggcacctcccgaccctattcttggagtttctgaagcattcaaagctgacacaagtgacatgaagctcaaccttggtgttggagcgtatcgtacagaagaacttcagccgtatgtgcttaaagttgtcaaaaaggctgagaatcttatgctcgaaaggggagaaaacaaggagtatcttccgatcgaaggtttagccgcattcaacaaagccacagctgagttgttgtttggagccgataatccagttctacatcaacagagagttgccaccattcaaggtctctcaggcaccgggtcccttcgagttgctgcagcattgattgaacgatactttccaggagcaaaagttctaatctcatctccaacttggggtaatcacaagaacatttttaacgatgctagagttccgtggtcagagtatcggtattacgatccgaaaacagttggccttgattttgatgggatgattgccgacataaaagctgctccagatggatcatttgtgcttcttcatggatgtgcgcacaacccaacaggtattgatccgactccggaacagtgggaaaaaatcgctgatgtcattcaagaaaagaaccatattccattctttgatgttgcttatcagggatttgctagtggaagcctggatgaagatgcatcttctgtgaggttgtttgccgcacgtggaatggagcttctggttgcacagtcatacagtaaaaatctcggtctttatgccgagagggttggtgcaattaatgtcctatgctcatcatctgatgcagctgtcagggtaaagagccagttgaaaagaatcgcaaggccaatgtactccaacccgcctgttcacggggctcgcattgtcgcaaacgttgtaggaaatccagacttttttaacgagtggaaagaggaaatggaaatgatggcgggaaggatcaaaagcgtgagacaaaagctgtacaataatctatctgcaaaggataagagcggaaaagattggtctttcatacttaagcagattggcatgttttcttttaccggtcttaataaggcccagagcgataacatgaccgataaatggcacgtttacatgacaaaagacggaagaatatcactggctggtttatctgctgcaaaatgcgagtatcttgcggatgctatcatcgattcatatcacaacgtcagttaataacagtcgctgcaaattcaaaaaacgccatcaataattagacaaggtagccttgtttattcagtcttgatataagtttgcagaagtgttgaaataaagtgaactttttgtgagaaaaccctttca

SEQ ID NO: 80 - protein, 459 aa, Helianthus exilis
MASIPLSSICPSAALSFREKCKDKTKSNVLFGKEKQPLYMKTKSRGRITMAVAVNTSRFDNITMAPPDPILGVSEAFKADTSDMKLNLGVGAYRTEELQPYVLKVVKKAENLMLERGENKEYLPIEGLAAFNKATAELLFGADNPVLHQQRVATIQGLSGTGSLRVAAALIERYFPGAKVLISSPTWGNHKNIFNDARVPWSEYRYYDPKTVGLDFDGMIADIKAAPDGSFVLLHGCAHNPTGIDPTPEQWEKIADVIQEKNHIPFFDVAYQGFASGSLDEDASSVRLFAARGMELLVAQSYSKNLGLYAERVGAINVLCSSSDAAVRVKSQLKRIARPMYSNPPVHGARIVANVVGNPDFFNEWKEEMEMMAGRIKSVRQKLYNNLSAKDKSGKDWSFILKQIGMFSFTGLNKAQSDNMTDKWHVYMTKDGRISLAGLSAAKCEYLADAIIDSYHNVS

SEQ ID NO: 81 - DNA, 1821 bp, Hordeum vulgare
  misc_feature (1646)..(1646): n is a, c, g, or t
  misc_feature (1650)..(1650): n is a, c, g, or t
  misc_feature (1753)..(1753): n is a, c, g, or t
ggtttaaaatcaatcattcccccggggttgagggcggccccaaactttttttttttttttttttttgacctaaaatccattgtcattctttctctcatgttaaaataaaaaacaacatgcctgcaagcgcggattgagccaattagaattattacaagcttgtaagcaccgcacaagtaactagcatccgtgagttttgccagattatttattactgtacctctggaattaacggacacatcatcagcatcctgacttacaactcgagctggaaggacccaaaaatcccagcaaactatagaaggaactactcacaatagcgtggctgcgacgcaaatcgtaatctagttgacattgtggaaggagtcgatgatggcatcagcaaggtactcgcatttcgccaggttcagccctgccaacgaaatcctcccgtccttggtcatatatatgtgccatttatcggtcatgttatcgctctggggtctgtccaagcccgtgaaggagaacatgcctatctggctaagaatgaaagaccagtccttgccagactggtcctttgcagtcaagctatcgtaaagcttctgccgaacattcttgatccgccctgccatttgttccatctcttctttccactcaccgaacatggtagggtctccaacaacgttggcgacgatcttggcaccgtgaataggtgggtttgagtacatgggccgcgccaatcgcttcaactggctcttcaccctatctgcaacttccggtgctgtgcaaatgacatttatcgcaccgatcctttctgcatatagaccaaggttcttgctgtaagactgtgcaacaaacacttccaggccacgcttaacaaaaagcctgacggaggatgcatcttcatcaaggcttccactggcaaaaccttgataggcaacatcaaagaaaggcatatgttttttctcttcaatcagatctgccagtttctcccactgttgaggagttgggtctattccagttggattgtgagcacaaccatgtagcagaacaaaagacccttctggggcagcctgtatgtcagctatcattccttcaaaatccagcccaacagtcttgggatcataataccggtattctgaccatggcaccctagcatcattgaatatgtttttgtggtttccccatgtgggagatgatataagtacttttgcatcagggaagtatctctgaataaatgctgcagcaaggcgtaatgatccagtccctgagagagactgaagagtagcaacccgtccttgcttgatgacaggattgtcagctccaagcaatagatctgcagttgctttgttaaatgcagcaaagccttcaataggcagatactctttgttttctcctttctctagcataagtttttcagccttcttgacaacgttgaggactgcgggctgtagctcttccgttctgtaggcgccaacaccaaggttgagcttcagatcacttgtatctgctttaaacgcttccgagaccccaaggatcgggtctggaggggccatcgacactccttcaaagcgagaagcgtgtactgtaagtgccaccgctatgtggcgcagttttttgtccctacgcgattcgccgagcgccggcatccacggcctcacccgtcncttnacttggtcacgcgcgaactactctagtcccgggcggcggcggcggcgacgcggaggcccggcgcggagagggcggaggcctccctggggcagagtgcagcttncgagcaggagggggcgagggtgatgtgggtccagagcggagcgggtggatggcgatggccttggacga

SEQ ID NO: 82 - protein, 427 aa, Hordeum vulgare
MPALGESRRDKKLRHIAVALTVHASRFEGVSMAPPDPILGVSEAFKADTSDLKLNLGVGAYRTEELQPAVLNVVKKAEKLMLEKGENKEYLPIEGFAAFNKATADLLLGADNPVIKQGRVATLQSLSGTGSLRLAAAFIQRYFPDAKVLISSPTWGNHKNIFNDARVPWSEYRYYDPKTVGLDFEGMIADIQAAPEGSFVLLHGCAHNPTGIDPTPQQWEKLADLIEEKKHMPFFDVAYQGFASGSLDEDASSVRLFVKRGLEVFVAQSYSKNLGLYAERIGAINVICTAPEVADRVKSQLKRLARPMYSNPPIHGAKIVANVVGDPTMFGEWKEEMEQMAGRIKNVRQKLYDSLTAKDQSGKDWSFILSQIGMFSFTGLDRPQSDNMTDKWHIYMTKDGRISLAGLNLAKCEYLADAIIDSFHNVN

SEQ ID NO: 83 - DNA, 1687 bp, Lotus japonicus
agtgattctcgcaatctttctttaatctcatcgttccctccgcaatccaatttcgattcatccgatggcggcgtcttcagtgttctctgtagcttcacactctgtttcgccttcgaatcaccatgctcacaagggaaaaaccaagattggaggtagcggtttgagattggcaaattcaaggtcttctggcagtggccggatctctatggctgttgctgttaatgcttctcgatttgagggaataccgatggctccacctgatccaattctcggagtttctgaagcatttaaagcggacaaatgcgatctcaagctcaatcttggagttggggcctacagaactgaagaattacagccatatgtgcttaatgttgttaagaaggcagagaatcttatgctgaatagaggggaaaacaaagagtatctacctattgagggttgggctgcatttaataaggcaactgcagagttgttactcggagctgacaacccagcaatcaaagaacaaagagttgccactgtccaaggtctttctggaactggttctctgcgactagctgctgctctgatagagcgatattttccaggggcaaaagttttgatatcatcccctacctggggtaatcacaagaatattttcaatgatgctagagtcccatggtcagagtaccgatattatgatcctaagacggttggattggattttgagggcatgttagaagatataaagtcagctcctgaaggatctttcgtgctacttcatggatgtgctcataaccctaccggtattgatcccacaccagaacagtgggtgaaaatagctgatctaattcaacaaaagaaccacattccattttttgatgtcgcttaccaggggtttgctagtggaagcctggatgaagatgctgcttctgtgcgatggtttgtgtcacgtggcatggaggttctagtagctcagtcatacagtaaaaatcttggtctctatgctgaaaggattggagcaatcaatgtcatttcctcatcaccagaatctgctgcaagggtaaagagccaattgaaaaggattgccaggccaatgtactctaatccaccggttcacggggctaggattgttgctgatatagttggaaatccagatctcttcaatgaatggaaagcagagatggaaatgatggcaggaaggataaagaatgttagacagaagctatatgatagtatttcttcaaaagacaagagtggaaaggattggtcattcatacttgagcagataggcatgttctcattcacaggcttgaacaagaatcagagtgacaatatgacaaataagtggcatgtatacatgacaaaagatggaaggatttccctggcaggattgtcactggccaaatgtgaataccttgcagatgctattattgactcttatcataatgtcagctgaaactggatgaaatattctttatcaccaagcttatattttttggtgagtattgtatccaatcatagtggtcggcacacatgacaataattcatgtaaacattaatgtcatacatgtacttttaattccctaggaaattttgtaaccttaaaataagttgaatcaaactattgatgcataatgagtctgcttctcggacttggagcaagttggatcaaagtattgatttataatgagactgtttctttcat

SEQ ID NO: 84 - protein, 457 aa, Lotus japonicus
MAASSVFSVASHSVSPSNHHAHKGKTKIGGSGLRLANSRSSGSGRISMAVAVNASRFEGIPMAPPDPILGVSEAFKADKCDLKLNLGVGAYRTEELQPYVLNVVKKAENLMLNRGENKEYLPIEGWAAFNKATAELLLGADNPAIKEQRVATVQGLSGTGSLRLAAALIERYFPGAKVLISSPTWGNHKNIFNDARVPWSEYRYYDPKTVGLDFEGMLEDIKSAPEGSFVLLHGCAHNPTGIDPTPEQWVKIADLIQQKNHIPFFDVAYQGFASGSLDEDAASVRWFVSRGMEVLVAQSYSKNLGLYAERIGAINVISSSPESAARVKSQLKRIARPMYSNPPVHGARIVADIVGNPDLFNEWKAEMEMMAGRIKNVRQKLYDSISSKDKSGKDWSFILEQIGMFSFTGLNKNQSDNMTNKWHVYMTKDGRISLAGLSLAKCEYLADAIIDSYHNVS

SEQ ID NO: 85 - DNA, 1806 bp, Marchantia polymorpha
  misc_feature (1805)..(1805): n is a, c, g, or t
cttcctcctctgctgtgtcggccctcggctctgccgctgtgagatggacatcccgctgcatttttgctcttgccgataataggtgcacctggactttcgttcctcaaaggcagttgtcaggcttgactagcgcaggcgtatctggtcaaaaggtggtcagcactacctcgtttgtgaaaaggcagttctcaggcttgagaggcgctgccttccctggccaaaaagtggtcagcacgcccttatttgtgaagtcgaactcgagaacgacaatgacgttggcagcaggagtatcgaaattcgaggccgtgacaatggcaccgcctgatccaattttgggtgtctctgaagcattcagggcagacaccagtgatgccaagctgaaccttggtgtcggcgcctaccgtaccgaggaactgcagccactagtattgaacgttgtcaaaaaggcagaaaagaagatgctggagtctggcgaaaacaaagagtaccttccaattgagggtcttgccgcctttaacaaagccacagcggaacttctactgggtgccgattctcctgccattaaggaaggacgggtagcaactgtgcaagggctctctggcactggctctctccgtcttggtgctgcgttcattcagcgatactttcctggtgccaaggttttgatctcatcaccaacatggggaaatcacaagaatattttcaacgacgctggtgtgccatggtcggagtaccgttactttgagccgaaaaccgtggggcttgattttgaaggaatgatggcagatatcaaggacgctcccagtggctcgttcatccttctgcacggttgtgcccacaacccaacgggaattgacccaacgccagagcaatgggagaaaatcgccgaccttattgaggagaaaggacacatggcctttttcgacgtcgcataccagggttttgcaagcgggagccttgatcaagacgccgactccgtcagactctttgtgaagcgtggacttgagattttggtcgcacaatcttacagcaagaatttgggtctgtatgctgagcgaatcggagctatcaatgcggttgtgcactcttcggatgttgctgtcagggttaagagtcagttgaagagactggcaaggccaatgtactcgaatccacctgttcacggtgcgaaaattgttgcaaacgtcgttggagatgccgcacttttcgatgaatggagagccgagatggaaatgatggctggacgcatcaaaaccgtcagacaaagactgtatgacgatctctcaaccaaggacaagagcggcaaagattggtcatttgtgctcaagcaaattggcatgttttctttcactggtctcaacagggcgcagagtgacaatatgtcggacaagtggcacgtgtacatgaccaaggatggtcgtatttccttggctggactttctctggctaagtgcagttatcttgctgatgctattatcgactcgtactacaatgtgcaataagtcagtgagattggagtcacgatcaaaaggcggccattggtccagttttgccctacttccccctcgcgtaatacagcatcgaaggatggtgggtttcacaaatgatgggtgaattgcccttatagtcggagctaaaagtccgggttacccacattcagagtatcgagtttggtcagggatgctttgtttctctcctcttttcattaaaacatgtagaatactacggcaacgatatctgttgaaagattcatcaggaaaattttctcgacaacctaataaagactgagtttagctgccaatcana

SEQ ID NO: 86 - protein, 410 aa, Marchantia polymorpha
MTLAAGVSKFEAVTMAPPDPILGVSEAFRADTSDAKLNLGVGAYRTEELQPLVLNVVKKAEKKMLESGENKEYLPIEGLAAFNKATAELLLGADSPAIKEGRVATVQGLSGTGSLRLGAAFIQRYFPGAKVLISSPTWGNHKNIFNDAGVPWSEYRYFEPKTVGLDFEGMMADIKDAPSGSFILLHGCAHNPTGIDPTPEQWEKIADLIEEKGHMAFFDVAYQGFASGSLDQDADSVRLFVKRGLEILVAQSYSKNLGLYAERIGAINAVVHSSDVAVRVKSQLKRLARPMYSNPPVHGAKIVANVVGDAALFDEWRAEMEMMAGRIKTVRQRLYDDLSTKDKSGKDWSFVLKQIGMFSFTGLNRAQSDNMSDKWHVYMTKDGRISLAGLSLAKCSYLADAIIDSYYNVQ

SEQ ID NO: 87 - DNA, 1797 bp, Nicotiana tabacum
taacaagatagaagaaggaagaacatctgaagatggcttccacaatgttctctctagcttctgccgctccatcagcttcattttccttgcaagataatctcaagtcaaagctaaagctggggactactagccaaagtgcctttttcgggaaagacttcgcgaaggcaaagtcaaatggtcggactactatggctgtttctgtgaacgtctctcgatttgagggaataacaatggctcctcctgaccccattcttggagtttctgaagcattcaaggctgatacaaatgaactgaagcttaaccttggagttggagcttaccgcacagaagatcttcaaccctatgtcctcaatgttgttaaaaaagcagaaaaccttatgctagagagaggtgacaacaaagagtatcttccaatagaaggtttggctgcattcaacaaagtcacagcagagttattgtttggagcagataacccagtgattcagcaacaaagggtggctactattcaaggtctatcaggaactgggtcattgcgtattgctgcagcactgatagagcgttacttccctggctctaaggttttaatatcatctccaacctggggaaatcataagaacattttcaatgatgccagggtgccttggtctgaatatcgatattatgatcccaaaacagttggcctggattttgctgggatgatagaagatattaaggctgctcctgaaggatcatttatcttgctccatggctgtgcgcacaacccaactggtattgatcccacaattgaacaatgggaaaagattgctgatgtaattcaggagaagaaccacattccattttttgatgtcgcctaccagggattcgcaagcggcagccttgatgaagatgcctcatctgtgagattgtttgctgcacgtggcatggagcttttggttgctcaatcatatagtaaaaatctgggtctgtatggagaaaggattggagctattaatgttctttgctcatccgctgatgcagcgacaagggtgaaaagccagctaaaaaggcttgctcgaccaatgtactcaaatcccccaattcacggtgctagaattgttgccaatgtcgttggaattcctgagttctttgatgaatggaaacaagagatggaaatgatggcaggaaggataaagagtgtgagacagaagctatatgatagcctctccgccaaggataaaagtggaaaggactggtcatacattctgaagcagattggaatgttctccttcacaggcctcaacaaagctcagagcgagaacatgaccaacaagtggcatgtgtacatgacaaaagacgggaggatatcgttggctggattatctgctgccaaatgtgaatatcttgcagatgccataattgactcatactacaatgtcagctaaaaatcttggatatgagaatagtagttcatagtaatatctggaggaaattcaatgtagttcattccttattttgagcaagttatcctcaaatattgtaataataatagtttttgatttgtctgcggttcacagatttcatctgtatgtagcaaattttgggacaacttctaaacagccagattctgtagttattatgtaagaaagttttccagagcgaaatactcgagtagacatcttagtctagctaattatcacttcaactatatttttgttgacatacaaaatctctaagcagactataggattcttaacaaacataacatcatgactaagctttatcctacttgtcggtattgcttaaagagtacctgcaggt

SEQ ID NO: 88 - protein, 462 aa, Nicotiana tabacum
MASTMFSLASAAPSASFSLQDNLKSKLKLGTTSQSAFFGKDFAKAKSNGRTTMAVSVNVSRFEGITMAPPDPILGVSEAFKADTNELKLNLGVGAYRTEDLQPYVLNVVKKAENLMLERGDNKEYLPIEGLAAFNKVTAELLFGADNPVIQQQRVATIQGLSGTGSLRIAAALIERYFPGSKVLISSPTWGNHKNIFNDARVPWSEYRYYDPKTVGLDFAGMIEDIKAAPEGSFILLHGCAHNPTGIDPTIEQWEKIADVIQEKNHIPFFDVAYQGFASGSLDEDASSVRLFAARGMELLVAQSYSKNLGLYGERIGAINVLCSSADAATRVKSQLKRLARPMYSNPPIHGARIVANVVGIPEFFDEWKQEMEMMAGRIKSVRQKLYDSLSAKDKSGKDWSYILKQIGMFSFTGLNKAQSENMTNKWHVYMTKDGRISLAGLSAAKCEYLADAIIDSYYNVS

SEQ ID NO: 89 - DNA, 1864 bp, Oryza sativa
gattctgaattttcccaggaatctgagcggccgcaaggcgtcacgcgaaacccgtccaacccaactccactccatcctctgcagccgcagttgtgacggagactccaaggccatcaccatccacccgctctcctcctcctcctcctccgcttgatccctccatctcctcgatcgatctccacactccactgcgcactgcaccagcaacgcccccccctgatccctctccacggctgcaccggagatggcttccgcccccttcgccgtctcctcctcaccggcggcttccgccgtggccgcgcgctccaaggtgttgcgaggagggaggagcgaggcgaggactggatgccgcctggggatcacgaggaagaattttggacgtgtcatgatggcccttgcagtagatgtctctcgttttgaaggagtgccgatggcccctccagacccaattctcggggtttcagaagcatttaaggcagatcaaaatgatctgaagctcaaccttggtgttggtgcctatagaacagaagagttacagccttatgtcctcaatgtggtcaagaaggctgaaactcttatgttggagaaaggagaaaacaaggagtatctgccaattgaaggcttagctgcatttaacaaagcaactgcagaactattgtttggagctgataatccagtactcaagcaaggacgtgttgctactcttcagtctctctcaggaaccgggtcgctgcgccttgctgcagcatttatacaaagatatttccctgaagcaaaagtactgatatcatctcccacttggggcaatcacaagaacattttcaatgatgcaaaggtaccttggtcagagtaccgttattacgaccccaagactgttggcttggattttgagggaatgatagctgacatacaggctgccccagatggatcttttgttctgctgcatggttgcgctcacaacccaactggaatagacccaactccggaacaatgggagaaaattgcagatgtcattcaagagaagaaacacatgcctttctttgatgttgcatatcagggttttgccagtggaagccttgatgaagatgcatcttctgtcaggctttttgttcaacggggactggaagtgtttgttgcgcagtcttatagcaaaaaccttggtttatatgcagaaagaattggagcaataaatgttgtctgctcaacacctgaagtcgcaaacagggtgaagagccagctgaaacgattggcacggcccatgtattcgaatccccctattcatggtgctaggatagttgccaacgttgttggggatccaaccatgtttggtgaatggaaacaggagatggaagaaatggcagggcgtatcaagaatgtaagacagaagctttatgatagtttgtctgcaaaggacgacagtggcaaggactggtctttcattctgaggcagataggcatgttctcctacacgggcttgaacaaaactcagagtgataatatgaccgacaaatggcacatatacatgacaaaggatgggagaatttcgttggctggattgtccctggctaaatgcgagtacctagctgacgccatcatcgactccttccataacgttagctagacgaggattcaggtcactgctattgtggttaatccttcaatatgctgggatttttggttccttccagcttgagttcttagccaggattgtatatccggcgctacgtaatttggagataataatgaattttgtctgtgcaacaaactttgcatatgctttgtcgaatgtacactggcactatgttagaagcttgaaatatcgaattgaataataatgagactagcaataagccaaactaattcc

SEQ ID NO: 90 - protein, 458 aa, Oryza sativa
MASAPFAVSSSPAASAVAARSKVLRGGRSEARTGCRLGITRKNFGRVMMALAVDVSRFEGVPMAPPDPILGVSEAFKADQNDLKLNLGVGAYRTEELQPYVLNVVKKAETLMLEKGENKEYLPIEGLAAFNKATAELLFGADNPVLKQGRVATLQSLSGTGSLRLAAAFIQRYFPEAKVLISSPTWGNHKNIFNDAKVPWSEYRYYDPKTVGLDFEGMIADIQAAPDGSFVLLHGCAHNPTGIDPTPEQWEKIADVIQEKKHMPFFDVAYQGFASGSLDEDASSVRLFVQRGLEVFVAQSYSKNLGLYAERIGAINVVCSTPEVANRVKSQLKRLARPMYSNPPIHGARIVANVVGDPTMFGEWKQEMEEMAGRIKNVRQKLYDSLSAKDDSGKDWSFILRQIGMFSYTGLNKTQSDNMTDKWHIYMTKDGRISLAGLSLAKCEYLADAIIDSFHNVS

SEQ ID NO: 91 - DNA, 1856 bp, Picea glauca
cgttaatttcgttcacagacatttatttattctgattttcaaatggctacctttgctgccgcatcagccaagcccatggctgtcatcgataactctcagttgagtctatgtcagaagaagtttgacggtcttcgggttggctatgcattcgccaagaggaaagacagttcctttttgaaagtgaagtctgtgagcagaattaacatggctcttgcaacagacgtttctcgctttgaaggagtgacaatggcacctccagatccaattctgggtgtttcagaagcatttaaagcagatacaaatgatttgaagcttaatcttggtgttggagcttacagaacagaagatcttcaaccctatgtgctcaatgtggtgaaaaaggcagagaatatgatgttggagaaaggagaaaataaggagtatctgcctattgaaggtttggctgcttttaataaggctactgtggagttgttgctgggagctgacaatgatgcaacaaagcaaggacgggtggcaactgtccaaggcctttcaggaactggttctcttcgccttgctgctgcctttattcaaagatattttcctggagtacaagtcttgatttcttctccaacttgggggaatcacaagaacattttcaatgatgctggtgttccatggtcggaataccggtactatgatcctaaaaccgtaggactagactttgaagggatgattgcagatattaaggctgcaccaagcggttcttttgtgttgcttcatggttgtgctcacaatccaactggaattgatccaactcctgagcagtgggagaagatcgctgatgttattcaggaaaaggatcttactgctttctttgatgttgcttatcagggatttgcaagtggcagtcttgatgaggatgcatcatctgtgaggctgtttgtagctcgtggaatggaagtttttgttgctcagtcctacagcaagaacttgggtctctatgcagaaaggataggagctattaatgttgtgtgctcatcatcagatgcagcaattagggtgaagagccaacttaaaaggcttgctagaccaatgtactcaaatcctccagttcacggggctcaaattgtggcaaatgttgttggtaatcctactctgtttgatgaatggaagtcagaaatggaacttatgtccggaagaatcaagggtgtgaggcagcgactctatgataatctttctgcaaaggataagactgggaaagattggtcctttgttctcagacagattggcatgttttccttcacgggccttaacaaagctcagagtgagaatatgtcaaataagtggcatatctacatgacaaaggatgggcgtatctccttggctgggctgtctctatccaaatgcgagtatcttgcagatgccatagttgactcttactataatgtcagttaaacaacaggaatatatcaaaacctactatcaattttctatgctagaaaatattcctaattttgaagcacctgacatcacattgagtgttgatgtctgaggcattctcatcagtattcatctacaaaattttgtctggtttaccgatctttcattgtttatcttgttaaataaaggtctgacattggttgccacctatctggcaggaagaccatagaacatattttacaagcagattctgctttctagaattgctatccttctattttgctagtgcagataacatttcaagttcataaaatatgagcctggtttttgaaatctagagatattgctgtttaattgtcttttatatcaaaggatttgagtattttttgtagcccactgcccaatttctgtaatgtcagatgcaaaatcttgtc

SEQ ID NO: 92 - protein, 464 aa, Picea glauca
MATFAAASAKPMAVIDNSQLSLCQKKFDGLRVGYAFAKRKDSSFLKVKSVSRINMALATDVSRFEGVTMAPPDPILGVSEAFKADTNDLKLNLGVGAYRTEDLQPYVLNVVKKAENMMLEKGENKEYLPIEGLAAFNKATVELLLGADNDATKQGRVATVQGLSGTGSLRLAAAFIQRYFPGVQVLISSPTWGNHKNIFNDAGVPWSEYRYYDPKTVGLDFEGMIADIKAAPSGSFVLLHGCAHNPTGIDPTPEQWEKIADVIQEKDLTAFFDVAYQGFASGSLDEDASSVRLFVARGMEVFVAQSYSKNLGLYAERIGAINVVCSSSDAAIRVKSQLKRLARPMYSNPPVHGAQIVANVVGNPTLFDEWKSEMELMSGRIKGVRQRLYDNLSAKDKTGKDWSFVLRQIGMFSFTGLNKAQSENMSNKWHIYMTKDGRISLAGLSLSKCEYLADAIVDSYYNVS

SEQ ID NO: 93 - DNA, 1899 bp, Physcomitrella patens
gagtattcaggcgaggtggcgtgttttgggcccttgaatcaatacgtgcaacttatgcatctctttagttcctccgcttctctgttgctcactcccgtctttgagcactccaccatctccagttgtttcttccttgactcgtcgctgttagattgcaatgactacagcgatggcgtcctcggctgcactgacagctcttgcgagcggccaagaagttcttcggagtggcgttacgcagaagttctctggccttagggttgccgctttccctctgaagaaggacaacgtcgctctttacgttaagggcaagtcaacgtcagtcatgtcggttgccactgatgtatctcgattcgagtcagtaaccatggctcctgcggaccccatcctgggagtttcagaggctttcaagaaggacaacagcgagaagaagctgaacttgggagtaggtgcttaccgaactgaggatctccagccctatgtattggaggtcgttaagaaggctgagaagaaaatgctggaaggtggcgacaacaaagagtaccttcccattgagggacttgctgctttcaacaaggctactgcagagttgctattgggagccgacaacgccgccattaaagagaaccgggttgccaccgtccaaggcctttctggtacgggttctcttcgcttgggtgctgctttcattcaacgttacttccctggcatcaccgtttacatctcttctccaacttggggaaaccacaagaacatatttaatgatgctggtgtcccatggaaagaataccgctactttgaccccaaaactgtcggcttagacttcgatggcatgatggaagacattgagaacgcacctgagggttcaattatattgttgcacgggtgtgcacacaacccaactggcattgacccaacaccagaccaatgggagaagattgctgatcttattcagcaaaagaaccatatggcattctttgatgtagcttaccagggtttcgccagtgggagcctggatgacgatgctagttccgtgaggaagttcgttgcccgtggtatggaggttttcgtggcacaatcctacagcaagaatctcggtctctatgccgagcgtgtgggtgctatcaatgcgattgtatcctctgcagatgttgctgctagggttaagagccagctgaagaggattgcaagaccaatgtactcaaacccacctgttcacggtgcccgtattgttgccaacgttgttggcgagccaactatgttcgacgagtggagagcagagatgcagatgatggctggccgtatcaagacagtgaggcagagattgtacgatgaactttctaccaaggacaagagtggcaaagattggtctttcgttctcaagcaaattggaatgttttcatttactggtctaaacaaggcacagagtgacaatatgactgacaaatggcacgtgtacatgaccaaggatggtcgtatttcacttgctggactcaacttggcaaagtgtgcttacttggccgatgctattattgactcttattacaacatccagtaacttcattagctgacttacttccttggagaggacattctcgatcttataatatggttcctaaatgaagtctttcttgcgttcaaaagttgggaatttagttttcacattttttgcacctagattctgtgtagtggatagagagagattgaccctgccgagtgtgttggtttccgcccagattgagaaaaggacttgagtgtccagtagaattgagcggcaatttcgacaaatttggcacttattgctcaggaagtgctgaaccaggagagtccagctggcttgttctttgattggctgctggagtagcctttttaatgggtatcatgtagtgacattttgattgc

SEQ ID NO: 94 - protein, 465 aa, Physcomitrella patens
MTTAMASSAALTALASGQEVLRSGVTQKFSGLRVAAFPLKKDNVALYVKGKSTSVMSVATDVSRFESVTMAPADPILGVSEAFKKDNSEKKLNLGVGAYRTEDLQPYVLEVVKKAEKKMLEGGDNKEYLPIEGLAAFNKATAELLLGADNAAIKENRVATVQGLSGTGSLRLGAAFIQRYFPGITVYISSPTWGNHKNIFNDAGVPWKEYRYFDPKTVGLDFDGMMEDIENAPEGSIILLHGCAHNPTGIDPTPDQWEKIADLIQQKNHMAFFDVAYQGFASGSLDDDASSVRKFVARGMEVFVAQSYSKNLGLYAERVGAINAIVSSADVAARVKSQLKRIARPMYSNPPVHGARIVANVVGEPTMFDEWRAEMQMMAGRIKTVRQRLYDELSTKDKSGKDWSFVLKQIGMFSFTGLNKAQSDNMTDKWHVYMTKDGRISLAGLNLAKCAYLADAIIDSYYNIQ

SEQ ID NO: 95 - DNA, 1836 bp, Picea sitchensis
gaggactctcatttttcgtcgacccgttaatttcgatcacagacatttacttattctgattttcaaatggctacctttgctgcagcatcagccaagcccatggctgtcatcgataactctcagttgagtctatgtcagaagaagtttgacggtcttcgggttggctatgcattcgccaagaggaaaagcagttcctctttgaaagtgaagtctgtgagcagaattaacatggctcttgcaacagacgtttctcgctttgaaggagtgacaatggcacctccagatccaattctgggtgtttcagaagcatttaaagcagatacaaatgatttgaagcttaatcttggtgttggagcttacagaacagaagatcttcaaccctatgtgctcaatgtggtgaaaaaggcagagaatatgatgttggagaaaggagaaaataaggagtatctgcctattgaaggtttggctgcttttaataaggctactgtggagttgttgctgggagctgacaatgatgcaacaaagcaaggacgggtggcaactgtccaaggcctttcaggaactggttctcttcgccttgctgctgcctttattcaaagatattttcctggagtacaagtcttgatttcttctccaacttgggggaatcacaagaacattttcaatgatgctggtgttccatggtcggaataccggtactatgatcctaaaaccgtaggactagactttgaagggatgattgcagatattaaggctgcaccaagcggttcttttgtgttgcttcatggttgtgctcacaatccaactggaattgatccaactcctgagcagtgggagaagatcgctgatgttattcaggaaaaggatcttactgctttctttgatgttgcttatcagggatttgcaagtggcagtcttgatgaggatgcatcatctgtgaggctgtttgtagctcgtggaatggaagtttttgttgctcagtcctacagcaagaacttgggtctctatgcagaaaggataggagctattaatgttgtgtgctcatcatcagatgcagcaattagggtgaagagccaacttaaaaggcttgctagaccaatgtactcaaatcctccagttcacggggctcaaattgtggcaaatgttgttggtaatcctactctgtttgatgaatggaagtcagaaatggaacttatgtccggaagaatcaagggtgtgaggcagcgactctatgataatctttctgcaaaggataagactgggaaagattggtcctttgttctcagacagattggcatgttttccttcacgggccttaacaaagctcagagtgagaatatgtcaaataagtggcatatctacatgacaaaggatgggcgtatctccttggctgggctgtctctatccaaatgcgagtatcttgcagatgccatagttgactcttactataatgtcagttaaacaacaggaatatatcaaaacctactatcaattttctatgctagaaaatattcctaattttgaagcacctgacatcacattgagtgttgatgtctgaggcattctcatcagtattcatctacaaaattttgtctggtttaccgatctttcattgtttatcttgttaaataaaggtctgacattggttgccacctatctggcaggaagaccatagaacatattttacaagcagattctgctttctagaattgctatccttctattttgctagtgcagataacatttcaagttcataaaatatgagcctggtttttgaaatctagagatattgctgtttaattgtcttttatatcaaaggatttgagtattttttgt

SEQ ID NO: 96 - protein, 464 aa, Picea sitchensis
MATFAAASAKPMAVIDNSQLSLCQKKFDGLRVGYAFAKRKSSSSLKVKSVSRINMALATDVSRFEGVTMAPPDPILGVSEAFKADTNDLKLNLGVGAYRTEDLQPYVLNVVKKAENMMLEKGENKEYLPIEGLAAFNKATVELLLGADNDATKQGRVATVQGLSGTGSLRLAAAFIQRYFPGVQVLISSPTWGNHKNIFNDAGVPWSEYRYYDPKTVGLDFEGMIADIKAAPSGSFVLLHGCAHNPTGIDPTPEQWEKIADVIQEKDLTAFFDVAYQGFASGSLDEDASSVRLFVARGMEVFVAQSYSKNLGLYAERIGAINVVCSSSDAAIRVKSQLKRLARPMYSNPPVHGAQIVANVVGNPTLFDEWKSEMELMSGRIKGVRQRLYDNLSAKDKTGKDWSFVLRQIGMFSFTGLNKAQSENMSNKWHIYMTKDGRISLAGLSLSKCEYLADAIVDSYYNVS

SEQ ID NO: 97 - DNA, 2087 bp, Pinus taeda
gttcgaactattctctgaatctcgtttgctttgatttgctctataattgttttatagctcattttccttctgtggtcgaggttcaaatcccgggaactgtatatttgccttatacttgcacagatattaagaatttttatctggatctataaaatttctgcgagatatttatttattctgattttcaatggctaccttcgctgctgcatcagccaagcccatggctgtcatcgataactctcagttgaatctatctcagaagaagtttgatggtcttcggattggccatgcgttcgccaagaggaaagacagttcctctttgaaagtcaaggctgtgagcagaattaacatgactattgcaacagatgtctctcgctttgaaggagtgacaatggcacctccagatccaattcttggtgtttcagaagcatttaaagcagatacaagtgatttgaagcttaatcttggtgttggagcttacagaacagaagaacttcaaccctatgtgctcaatgtggtgaaaaaggcagagaatctgatgttggaaaagggagacaataaagagtacctccctattgaaggtttggctgcttttaataaggctactgtggaattgttgctgggagctgacaataatgcaaccaagcaaggacgggtggctactgtccaaggcctttcaggaactggttctcttcgcctcgctgctgcctttattcaaagatatttccctggagcacaagtcttgatttcttccccaacttgggggaatcacaagaacattttcaatgatgctggggttccatggtcggaataccggtactatgatcctaaaactgtaggactagattttgaagggatgattgcagacattaaggctgcaccaagtggttcttttgtgctgcttcatggttgtgctcacaatccaactggaattgatccaactcctgagcagtgggagaagattgctgatgtcattcaggaaaagaatcttactgctttctttgatgttgcttatcagggatttgcaagtggcagtcttgatcaggatgcatcatctgtgaggttgtttgtagctcgtgggatggaagtttttgttgctcagtcctacagcaagaacttgggcctctatgcagaacggataggagctatcaatgttgtgtgctcctcatcagatgcagcaactagggtgaagagccagcttaaaaggcttgctagaccaatgtactcaaatcctccagttcatggggctcgaattgtggcaaatgttgttggtaatcctactctgtttaaagaatggaagtcagaaatggaacttatgtctggaagaattaagggtgtgaggcagcgactctatgataatctttctgcaaaggataagagtgggaaagattggtcttttattcttagacagattggcatgttttccttcacgggccttaacaaagctcagagtgataatatgacaaataagtggcatgtctacatgacaaaggatgggcgtatttccttggctggtctgtcgctgtccaaatgcgagtaccttgcagatgccatatttgactcctactataatgtcagctaaacaacaggattatatcaaaatctaatatcaattttctatgctagaaatattactaattttgaagcacctgacatcacattgggtgttgatgtctgaggcattcttatcagtatgcattctacaaaattttggctgcttaccgatctttcattgttcattttgttaaataaaggtctgacattggatgccacctgtttggccggaagaccatagagtatttttcaagcagattctgctttctccagtttctgtcctatttttctagagcagataacatttaaagttagtaaaatataagctcggtttttgaaatctagggatattgctgtttaattgtcttctatataaagggatttgaataacttttgtagtccagtgcccaatttctgtaacgtcagatggaaaattgtgtcaggtcttagcatatcttgtacgtgttgtcattggtagttattagcacttgtgcagctatatgccggaattcacacaaatagattcagttctg

SEQ ID NO: 98 - protein, 464 aa, Pinus taeda
MATFAAASAKPMAVIDNSQLNLSQKKFDGLRIGHAFAKRKDSSSLKVKAVSRINMTIATDVSRFEGVTMAPPDPILGVSEAFKADTSDLKLNLGVGAYRTEELQPYVLNVVKKAENLMLEKGDNKEYLPIEGLAAFNKATVELLLGADNNATKQGRVATVQGLSGTGSLRLAAAFIQRYFPGAQVLISSPTWGNHKNIFNDAGVPWSEYRYYDPKTVGLDFEGMIADIKAAPSGSFVLLHGCAHNPTGIDPTPEQWEKIADVIQEKNLTAFFDVAYQGFASGSLDQDASSVRLFVARGMEVFVAQSYSKNLGLYAERIGAINVVCSSSDAATRVKSQLKRLARPMYSNPPVHGARIVANVVGNPTLFKEWKSEMELMSGRIKGVRQRLYDNLSAKDKSGKDWSFILRQIGMFSFTGLNKAQSDNMTNKWHVYMTKDGRISLAGLSLSKCEYLADAIFDSYYNVS

SEQ ID NO: 99 - DNA, 1701 bp, Populus trichocarpa
aacccatcattatttcaagcgccatttacagttctgtcaaatccagtcacacaaatacttttagatcactcaagtagctgtttgattttatcaaaatcattccttagaaatctaatcatcgagcagtgttattttttgttattcagatggcttcaacaatgctttctttagcttctaccactccttctgcttcactttctatgcaagaaattctcaagggaaaggcgaggcttggaagtggtagtgtgagtacattgtttaacaaggagaaaggcaatccctttatcaaggcaaagtcatttggccggatatctatgactgtcgcagttaatgtatctcgttttgagggtatagctatggctcctcctgatcctatccttggtgtttctgaagcttttagagcagacacggatgtaaagaagctcaaccttggagttggggcctaccgaactgaagagttacagccttatgtgcttgatgtcgttaagaaggctgagaatcttatgctggagaggggtgaaaacaaggagtatctcccaattgaaggtttggctgcattcaataaggtgactgcagagttattattcggagctgacaacccagtgataaaacaacaaagagttgcaactgttcaaggtctttcaggcactggttcgcttcgattagctgcagcgctcattgagagatattttcctggagcgcaagttctgatatcatctccaacttggggtaatcacaagaatattttcaatgatgcaagagttccatggtccgagtaccgatactatgatcccaaaacagttggcttggattttgaggggatgatatcagacataaaggcagcccctgagggatcatttgtattgcttcatggctgtgcacacaacccgactggtattgatccaacccctgaacaatgggagaaaattgctgatgtcattcaagaaaagaaccacgttccattttttgatgtggcctaccagggattcgctagtggaagcctcgatgcagatgcatcatcagtgaggttgtttgctgcacgtggtatggagcttttgattgctcagtcgtacagcaaaaacttgggcttgtatgctgaaagaattggggcaattaatgttgtctgctcatcggcagatgcagcagcaagggttaagagccagctgaaaaggattgcccgaccaatgtactcaaatcctcctgttcacggtgctaggattgttgctaacgttgttggggatccaattctctttaatgaatggaaagaagagatggagatgctggctggaaggataaaaaatgtgaggcagaaactatttgacagtctctccgcaaaagataagagtgggaaagattggtcttttatactgaagcagattggcatgttctccttcacaggcttgaacaaaactcagagcgaaaatatgaccaacaagtggcatgtctatatgacaagggatggaagaatatccttggcaggactgtctttggccaaatgtgaataccttgctgatgccattattgactcttaccataatgtcagttgatggagatagtgaacgggtataccagaaccaacagttaataaattttggtgacttcgatgttttactgagtttatattattttacagaaattttgtaataatgttcactggtatgaccgtcacaaatccatgtaaactgagctttgattgaggct

SEQ ID NO: 100 - protein, 466 aa, Populus trichocarpa
MASTMLSLASTTPSASLSMQEILKGKARLGSGSVSTLFNKEKGNPFIKAKSFGRISMTVAVNVSRFEGIAMAPPDPILGVSEAFRADTDVKKLNLGVGAYRTEELQPYVLDVVKKAENLMLERGENKEYLPIEGLAAFNKVTAELLFGADNPVIKQQRVATVQGLSGTGSLRLAAALIERYFPGAQVLISSPTWGNHKNIFNDARVPWSEYRYYDPKTVGLDFEGMISDIKAAPEGSFVLLHGCAHNPTGIDPTPEQWEKIADVIQEKNHVPFFDVAYQGFASGSLDADASSVRLFAARGMELLIAQSYSKNLGLYAERIGAINVVCSSADAAARVKSQLKRIARPMYSNPPVHGARIVANVVGDPILFNEWKEEMEMLAGRIKNVRQKLFDSLSAKDKSGKDWSFILKQIGMFSFTGLNKTQSENMTNKWHVYMTRDGRISLAGLSLAKCEYLADAIIDSYHNVS

SEQ ID NO: 101 - DNA, 1645 bp, Populus trichocarpa
tactacttgattacgaacattaccacagaacaactccagtatctatagccaacggtttttcaagatggcttcaacaatgatttctttagcttctgctactccttctgcttcactttctgtgcaagaaactctcaagggaaagatgaggcttggaagtagtagtgtgagtacattgtttaacaaggagaaaggcaatccctctatcaagaaaaagtcatttggccggatatctatgactgttgcagtgaatgtatcccgtttcgagggtattgctatggccccccctgatcctatccttggtgtttctgaagcttttagagcagacatagatgtaaagaagctcaaccttggagttggggcctaccgaactgaagagttacaaccttatgtgcttgatgttgttaagaaggctgagaatcttatgctggagaggggagaaaacaaagagtatctcgcaatcgaaggtttggctgcattcaataaggtgactgcagagttactattcggagcagacaaccaagtgatagagcaacaaagagttgcaactgttcaaggtctctcgggcaccggttctcttcgattagctgcagctctcattgagcgatattttcctggagcgcaagttctgatatcgtctcctacttggggtaatcacaagaatattttcaatgatgcaagagttccatggtcagagtaccgatactatgatcccaaaacagttggcttggattttgaggggatgatatcggacataaaggcagcccctgagggatcatttgtgttgctacatggctgtgctcacaacccaactggtattgatccaacccctgaacaatgggagaaaattgctgatgtcattcaagaaaagaaccatattccattttttgatgttgcctaccagggatttgctagtggaagccttgatgcagatgcatcatcagtgaggttgtttgctgcacgtggtatggagcttctggttgctcagtcatacagcaaaaatttgggtttgtatgccgaaagaattggggcgattaatgttgtctgctcatcagctgatgcagcagcaagggttaagagccaactgaaaaggattgcccgaccaatgtactcaaatcctcctgttcatggggctagaattgttgctaatgttgttggggatccagctcttttcaatgaatggaaggcagagatggaaatgatggctgggaggataaaaaatgtgagacagaagctatttgacagtctctctgcaaaagataaaagtgggaaagattggtcttttatactgaagcagattggcatgttttccttcactggcttgaacaaagctcagagcgataatatgaccaacaagtggcatgtttatatgacgaaggatggaagaatatccttggctggactgtctttggccaaatgtgaataccttgctgatgcaattattgactcctaccacaatgtcagttgaaagaatgatgaacaggcattataaccaacaagtaaaaagttttatcactaaactgttttactgagttgatattattttacggaagttttgtaataatgttcactggtatttgactgaaacaaatccatgcaaaccgagttttgataggctgtttattacatcccagctggggctaagcta

SEQ ID NO: 102 - protein, 466 aa, Populus trichocarpa
MASTMISLASATPSASLSVQETLKGKMRLGSSSVSTLFNKEKGNPSIKKKSFGRISMTVAVNVSRFEGIAMAPPDPILGVSEAFRADIDVKKLNLGVGAYRTEELQPYVLDVVKKAENLMLERGENKEYLAIEGLAAFNKVTAELLFGADNQVIEQQRVATVQGLSGTGSLRLAAALIERYFPGAQVLISSPTWGNHKNIFNDARVPWSEYRYYDPKTVGLDFEGMISDIKAAPEGSFVLLHGCAHNPTGIDPTPEQWEKIADVIQEKNHIPFFDVAYQGFASGSLDADASSVRLFAARGMELLVAQSYSKNLGLYAERIGAINVVCSSADAAARVKSQLKRIARPMYSNPPVHGARIVANVVGDPALFNEWKAEMEMMAGRIKNVRQKLFDSLSAKDKSGKDWSFILKQIGMFSFTGLNKAQSDNMTNKWHVYMTKDGRISLAGLSLAKCEYLADAIIDSYHNVS

SEQ ID NO: 103 - DNA, 1863 bp, Phaseolus vulgaris
gcacgaggaactgtcttctctttcttcacttcttctcatcgcccattgtttccttcttcaattctatctctctaagcttcttcaagtgtttcacaaaaacgaatctacttcatcgcatcatcgtcttttctacgcaactcaacttctacaacactcagatccgcacttcacagtgatggcttcttctgttctctccgcagctttgaactctctctctccctcttattctctctcctcgcgccaaacccacaaggggaagcccaagattggaggcaacgctttgagatttaacaagtccttcccaaatgcaaggtctagtggtcgggttatggctgttgcagttaatgggtctcggtttgagggcatacctatggctcctcctgatccaattcttggagtttctgaggcatttaaagcggacacaagtgatgtcaagctcaatcttggagtgggggcataccgaacagaagaactacagccgtatgtgcttaatgttgttaagaaggctgagaatcttatgctggagaggggggataacaaagagtatctctctattgagggtttagctgcgtttaacaaggcaactgcagagttgttacttggagcagacaacccagcaatcaaacagcaaagagttgccactgtccaaggtctttctggaactggttctctgcggctagctgcagctctgatagaaagatattttgctggggctaaagttttgatatcatctcctacctggggtaatcacaagaatattttcaatgatgctagagtgccatggtctgagtacagatattatgatcccaagacagttggcttggattttgagggcatgattgaagatataaagtcagctcctgaaggatcttttgtgcttctacatggatgtgctcataaccctactggtattgatccaacacctgagcaatgggaaaaaatagctgatttaattcaagaaaagaaccacattcccttttttgatgttgcttaccagggctttgctagtggaagccttgatgaagatgcagcttctgtgaggctttttgttgcacgtggtatggaggttcttgtagctcagtcatacagtaaaaatcttggtctctatgctgaaaggattggagcaatcaatgtgatttcatcatccccagaatctgcagcaagggtaaagagccagctgaaaaggctcgcccgaccaatgtactcaaatccacctgtacatggggctagaattgttgccgatgttgttggaaacccagttctctttaatgaatggagagcagaaatggaaatgatggctggaaggatcaagaatgttagacaacagctatacaatagtattacttcaaaagacaacagtggaaaagattggtcatttatacttaagcagataggcatgttctcattcactggcttgaacaaggaacagactgacaacatgacaaataagtggcatgtatacatgacaaaggacggaaggatttccctggcaggattgtcgttggctaaatgtgaataccttgcagatgctattatagactcgtatcataatgtcagctgaaactcggtgaaatatttttggtgagtgttatatccaatcggaaagattgtgagatacatgaaaataatttatgtatgcattaattaattgtcatacatatgtacctcaaagtaccttaggaaattttgtaaccttgttgaaacaaattgactctgtattgacgcataacaagtcggattgtctgacttaaagctagttgaatcagcaccgatttatagtatatttctcatttcatatgggtgagactgaatatcatggtaacaaacttccattggccataatgtcatttcgtggttggtcgg

SEQ ID NO: 104 - protein, 461 aa, Phaseolus vulgaris
MASSVLSAALNSLSPSYSLSSRQTHKGKPKIGGNALRFNKSFPNARSSGRVMAVAVNGSRFEGIPMAPPDPILGVSEAFKADTSDVKLNLGVGAYRTEELQPYVLNVVKKAENLMLERGDNKEYLSIEGLAAFNKATAELLLGADNPAIKQQRVATVQGLSGTGSLRLAAALIERYFAGAKVLISSPTWGNHKNIFNDARVPWSEYRYYDPKTVGLDFEGMIEDIKSAPEGSFVLLHGCAHNPTGIDPTPEQWEKIADLIQEKNHIPFFDVAYQGFASGSLDEDAASVRLFVARGMEVLVAQSYSKNLGLYAERIGAINVISSSPESAARVKSQLKRLARPMYSNPPVHGARIVADVVGNPVLFNEWRAEMEMMAGRIKNVRQQLYNSITSKDNSGKDWSFILKQIGMFSFTGLNKEQTDNMTNKWHVYMTKDGRISLAGLSLAKCEYLADAIIDSYHNVS

SEQ ID NO: 105 - DNA, 1681 bp, Solanum lycopersicum
ccctctgtggtagctttcctgtaaacccaaagtcccgaaacccttgtatgccctcttcttcttttgcgcacttaaatcccagatggcttccacaatgttctctctagcttctgtcactccttcagcttcaatttccttgcaagataatctcaagccaaagctgaagctagggacttctagccaaagggcctttcccaggaaggacttcatgaaggcaaagtcaaatggtcggactactatggctgttgctgttaacgtctctcgatttgagggaataacaatggctccccctgaccccattcttggagtctctgaagcattcaaggctgatacaaatgaactgaagcttaaccttggagttggagcttaccgcacagaggatcttcaaccatatgtcctcaatgttgttaagaaagcagagaaccttatcctggagagaggagaaaacaaagagtatcttccaatagaaggtttggctgcattcaacaaagtcacagcagagttattgtttggaaaagataacccggtgcttcagcaacaaagggtggctacgattcaaggtctatcaggaactgggtcattgcgtattgctgcagcactgatagagcgttacttccctggctctaagattttgatatcatctccaacatggggaaatcataaaaacatttttaatgatgccagagtaccttggtctgaatatcgatattatgatcccaaaacagttggccttgactttgctgggatgatagaagatataaaggctgccccagaaggatcatttatcttgctccacggctgtgcacacaacccaactggtattgatcccacacctgagcaatgggaaaagatcgctgatgtaattcaggagaagaaccacattccattttttgatgttgcctaccagggatttgcaagtggcagccttgacgaagatgcctcatctgtgagaatgtttgctgcacgtggtatggagcttttggttgctcaatcatatagtaaaaatctgggtctctatggagaaaggattggggctattaatgttctttgctcatctgctgatgcagcaacaagggtgaaaagccagctaaagaggcttgctcgaccaatgtactccaatcctcccattcacggtgctaaaattgttgccaatgtcgttggaactccagagctcttcagtgaatggaaagaagagatggaaatgatggcagggaggataaagagtgttagacagaagctatatgatagcctctccgccaaggataagagtggaaaggactggtcgttcattctgaagcagataggaatgttctccttcacaggtctcaacaaagctcagagcgagaacatggccgataagtggcatgtgtacatgacaaaagatgggaggatatccttggctggattatcggctgctaaatgtgaatatcttgctgatgccatcattgactcatactacaatgtgagctaattcttggattttaaagtgacaacagttttgataataatatctgcaggaatttcactgtatacttcattcttcctgttgagcacgtgattctcttaaatcttgtaataattgtttcagcttgtcttcggtttacagaatttatatttgtatgaagcaaattttgacaatttcttaacagttggattctaaaataaagattaatgctagagt

SEQ ID NO: 106 - protein, 462 aa, Solanum lycopersicum
MASTMFSLASVTPSASISLQDNLKPKLKLGTSSQRAFPRKDFMKAKSNGRTTMAVAVNVSRFEGITMAPPDPILGVSEAFKADTNELKLNLGVGAYRTEDLQPYVLNVVKKAENLILERGENKEYLPIEGLAAFNKVTAELLFGKDNPVLQQQRVATIQGLSGTGSLRIAAALIERYFPGSKILISSPTWGNHKNIFNDARVPWSEYRYYDPKTVGLDFAGMIEDIKAAPEGSFILLHGCAHNPTGIDPTPEQWEKIADVIQEKNHIPFFDVAYQGFASGSLDEDASSVRMFAARGMELLVAQSYSKNLGLYGERIGAINVLCSSADAATRVKSQLKRLARPMYSNPPIHGAKIVANVVGTPELFSEWKEEMEMMAGRIKSVRQKLYDSLSAKDKSGKDWSFILKQIGMFSFTGLNKAQSENMADKWHVYMTKDGRISLAGLSAAKCEYLADAIIDSYYNVS

SEQ ID NO: 107 - DNA, 1365 bp, Volvox carteri
cacacatgcgcttcgcgtctctgtagtaattactactctggtcgggtcatgctgtttgcctttaccaaaatgcagcaggtcatttcgcgccgcgtcggcgctcacatttgcgatgtgggtgcctctcgcagccgtcttgccctgcaggtcaggtgcatgagccgctttgctgatgtggctcaggctcctccggacccgatcttgggcgtctcggaggccttccgcgcaagcaccagccctagcaagcttaatctcggcgtgggcgcgtaccgggatgaggatttgaagcctgtcgtgctgagcgtggtgaagaaggccgaggctaagattttctcccgcaatgagaacaaagaatacctgtccattgagggtttcgagcccttccgtaaggccactgtggacctgctgctgggtgctggtcatccggccattaaggagggtcgtgtggcggtgatccagtctctgtctggcaccggctctctgcgtgtgggtgctgccttcatcgcccgcttcctcaagggcgctactgtctacatctccaacccgacctggggcaaccaccgcaacatctttggtgacgagggtgtcaagtgggagtactacaggtattttgatgccgacactgttggtctggacttcaagggccttatggaggacctgaaggcggctccctctggctccgtggtggtgctgcatggctgcgcacacaaccccacgggcgtcgatccgacccccgagcagtggaccgccattgcggacttgtgcaaggagcgcaacctgttgcccttcttcgatgtggcctatcagggcttcgccactggtgacctggacaaggacgcctttgccccccgcctctttgtggaccggggtctggagatcatggtttcccagagctactcgaagaacctgggactgtacggcgagcgtgtgggtgctctggtcatggtgctcaaggacaaggagcctgccactcggtgtctgagccagctgaagcgcctggcccgtgccctgtactcgaacccgccaacccacggagctcgaattgctgctgaggtggtcaatgacaaggagctgttcgaggagtggaagggtgagatgcgcggtatggctggccgcattgagcgggtgcgtggagagctccagcgggctctggaggccaaataccccgacaaggactggtccttcatcaccaagcagattggaatgttcaccttcaccggtctcacgcctgcacaggtggacaacatgaccaacaagcactctgtgttcatgacccgggatggccgcatctccctggccggtctcaactctgccaaggtggagtacctggccaacgctattgttgaatcggtgcgcaactgctaa

SEQ ID NO: 108 - protein, 438 aa, Volvox carteri
MLFAFTKMQQVISRRVGAHICDVGASRSRLALQVRCMSRFADVAQAPPDPILGVSEAFRASTSPSKLNLGVGAYRDEDLKPVVLSVVKKAEAKIFSRNENKEYLSIEGFEPFRKATVDLLLGAGHPAIKEGRVAVIQSLSGTGSLRVGAAFIARFLKGATVYISNPTWGNHRNIFGDEGVKWEYYRYFDADTVGLDFKGLMEDLKAAPSGSVVVLHGCAHNPTGVDPTPEQWTAIADLCKERNLLPFFDVAYQGFATGDLDKDAFAPRLFVDRGLEIMVSQSYSKNLGLYGERVGALVMVLKDKEPATRCLSQLKRLARALYSNPPTHGARIAAEVVNDKELFEEWKGEMRGMAGRIERVRGELQRALEAKYPDKDWSFITKQIGMFTFTGLTPAQVDNMTNKHSVFMTRDGRISLAGLNSAKVEYLANAIVESVRNC

SEQ ID NO: 109 - DNA, 1233 bp, Vitis vinifera
atggctattgcagtcaatacctctcgttttgaaggtgtaacaatggcccctcctgatccaattcttggagtttctgaggctttcagagcagacaatagtgagatgaagctcaaccttggagtcggggcctaccgaacagaagaactccaaccttatgtgcttaatgttgtcaagaaggcagaaaatcttatgctggagagaggagaaaataaagagtatcttccgatcgaaggtttggctgcatttaataaagttacagcagagttattatttggagcaggcaatccagtaattgagcaacaaagggttgcaaccgttcaaggtctttctggaactggttctcttcgacttgctgcggcccttatagaacgatattttcctggggcaaaagttttgatatcatcgccaacatggggtaatcacaagaatattttcaatgatgctagagttccctggtctgaataccgatactatgacccaaaaacagttggcttggattttgatgggatgatatccgatataaaggcagccccagaaggatcttttgtgttgcttcatggctgtgctcacaacccaactggtattgatccaactcctgaacagtgggaaaagattgctgatgtcattcaagagaagaatcacattcctttctttgatgttgcataccagggatttgcaagtggaagccttgatgcagatgcgtcatccgtgagattgtttgctgcacgtggtatggagcttctggttgcccaatcatacagtaaaaatctgggtctttatgcagaaaggattggggcaatcaatgtggtctgctcatcagcagatgcagcagcaagggtaaagagtcagttgaaaaggattgctcgaccaatgtactcaaatcctcctattcatggagctaggattgttgccaatgttgttggtgatccagctctcttcaatgaatggaaagaggagatggaattgatggctggaaggataaagaatgtgagacagaaactatttgacagcctctctgcaaaagataagtgtggaaaggattggtcatttatactaaagcagattggcatgttctcattcacagggctgagcaaagttcagagtgagaatatgacaaataagtggcatgtgtacatgaccaaggacgggaggatctcattggctggattgtctttggccaaatgcgaatatcttgcagatgccatcattgattcatttcactgtgtcagttga

SEQ ID NO: 110 - protein, 410 aa, Vitis vinifera
MAIAVNTSRFEGVTMAPPDPILGVSEAFRADNSEMKLNLGVGAYRTEELQPYVLNVVKKAENLMLERGENKEYLPIEGLAAFNKVTAELLFGAGNPVIEQQRVATVQGLSGTGSLRLAAALIERYFPGAKVLISSPTWGNHKNIFNDARVPWSEYRYYDPKTVGLDFDGMISDIKAAPEGSFVLLHGCAHNPTGIDPTPEQWEKIADVIQEKNHIPFFDVAYQGFASGSLDADASSVRLFAARGMELLVAQSYSKNLGLYAERIGAINVVCSSADAAARVKSQLKRIARPMYSNPPIHGARIVANVVGDPALFNEWKEEMELMAGRIKNVRQKLFDSLSAKDKCGKDWSFILKQIGMFSFTGLSKVQSENMTNKWHVYMTKDGRISLAGLSLAKCEYLADAIIDSFHCVS

SEQ ID NO: 111 - DNA, 1913 bp, Zea mays
gcctctcaaaaaaggaaaaggaaacggaaaaactcccagttcgtgacggagacaccgaggccagcgccatccacccgctcccctccgcgcccggccgcaccgctcccctccgctcggccttcatctccccacagccgcaagcgacgggcgtcatatcccatcctgatctctcctcccttcttcagtgcagcagcaggccagcggcacgccacccgcctcactcccgcctccgatccgctgcttactcgccacccggagatggccaccgccgccgccttctctgtctcctcgccggcggcctccgccgtcgccgcgcgatccaaggtgtttggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataaaagcgagctgaagctcaatcttggtgttggtgcctataggacagaagagctgcagccctacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtcagagtaccggtattatgaccccaagactgttgggttggattttgagggaatgatagctgacattgaggctgctcctgaaggttcttttgttctgctacatggttgtgctcacaacccaactggaatagacccaactcctgaacagtgggagaaaattgcagatgtcattcaagagaaaaagcatatgccattctttgatgttgcatatcagggttttgccagtggaagccttgatgaagatgcattttctgtcaggctttttgttaagcgtggcatggaagtgtttgttgcacaatcttacagcaagaaccttggtttatattctgaaagggttggtgcaataaatgtcgtgtgctcagcaccagaagttgcagatagggtaaagagccagctgaaacgattggcacgtcccatgtactcgaacccccctattcacggtgccaagatagttgccaacgttgttggtgatccaaccatgtttggtgaatggaaacaagagatggagctaatggctggacggatcaagaatgtaagacagaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactaggctgaggtacgatagttgagggtcaagctattgatgtttagttccgtggacgctaggctgggatttttgggtccttccagctatacagctcttccgttgtgctccatctggtgtaacttggataaataaaaattttgtcgctgaactaaaactcgtgtgcttttttacctgtaactgtaaggtcagcgcgtggctacagacttgtaaacacttgaatggaaaaaaaacaatgacattaccggatattaatggccaactggccggtatgcgaactt

SEQ ID NO: 112 - protein, 459 aa, Zea mays
MATAAAFSVSSPAASAVAARSKVFGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLLGADNPVINQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERVGAINVVCSAPEVADRVKSQLKRLARPMYSNPPIHGAKIVANVVGDPTMFGEWKQEMELMAGRIKNVRQKLYDSLSAKDKSGKDWSFILRQIGMFSYTGLNKAQSDNMTDKWHIYMTKDGRISLAGLSLAKCDYLADAIIDSFHNVN

SEQ ID NO: 113 - DNA, 1701 bp, Arabidsopsis thaliana
ggccattttctaagcaacttgtgcgactctccttcgtcctcatctgccaaaaacttcgtacgagtcgctacttctctctctatatataaactccttaccactctctttttctgattttttgacgttaagagatagaaacagagagagatagagagatagagttatggctttggcgatgatgatccgaaacgcagcttcgaagcgaggaatgactccgatctccggtcatttcggtggtttgagatctatgtcttcatggtggaagagcgttgagcctgctcctaaagatccgatcctcggagttaccgaagcttttctcgctgatcctagtcctgaaaaagttaatgttggtgtgggagcatatcgtgatgataatgggaagcctgttgtcttggaatgtgtcagagaagctgagaaaaggcttgctgggagcactttcatggagtaccttcctatgggaggaagtgccaaaatggtggacctaacattgaagcttgcctatggggacaatagtgaatttatcaaagataaaagaattgctgcagttcagactctgtctggcactggagcctgccggctctttgcagacttccagaaacgtttttctcctggttcacagatctacattcctgttccaacctggtccaaccaccacaacatctggaaagatgcacaagtccctcaaaagacatatcattactatcatccagaaaccaagggcttggatttctcagcattgatggatgatgtgaagaatgctccggaagggtcattcttccttcttcatgcttgtgctcataatcctactggagtagaccctacagaggaacaatggagagagatatcacagctattcaaggctaaaaagcatttcgcattcttcgatatggcttaccaaggttttgctagtggagatccagcgagagatgccaagtccatcaggatctttcttgaagatggtcatcatattggaatttctcagtcctatgcaaaaaacatgggactctacggccagagggtgggatgtctcagtgtgctttgtgaagatccgaagcaagccgtggctgtgaaaagtcaattgcagcagctagctagaccaatgtacagcaacccacctttgcatggtgctcagctggtctcaaccattcttgaagacccagagttaaagagtctgtggctaaaagaagttaaggtcatggctgataggatcatcggcatgagaactactttgcgagaaagccttgagaagttaggatcgcctttgtcatgggagcacgttaccaaacagattggaatgttctgctacagtgggttaacaccagaacaggttgaccgcttaacaagcgaatatcacatctatatgacccgtaacggccgtatcagtatggctggtgttacaacaggaaacgtgggataccttgcgaatgctatacatgaagtcaccaagtcatcttaaatcatttacttacatgtttcagccaaacatacaaattttgtttgaagagtcaataagacaggaggctagatttgtacttctgcaattggttttgtgggaactgaaagtttacccataaacagtaatttattagcgcattttttcgttagctgggcaataaaagcaaagcctaaacgatggatttttggatatacaaaattcggattgttttctttcttctcaattgctctttttgtgcttgtttc

SEQ ID NO: 114 - protein, 430 aa, Arabidsopsis thaliana
MALAMMIRNAASKRGMTPISGHFGGLRSMSSWWKSVEPAPKDPILGVTEAFLADPSPEKVNVGVGAYRDDNGKPVVLECVREAEKRLAGSTFMEYLPMGGSAKMVDLTLKLAYGDNSEFIKDKRIAAVQTLSGTGACRLFADFQKRFSPGSQIYIPVPTWSNHHNIWKDAQVPQKTYHYYHPETKGLDFSALMDDVKNAPEGSFFLLHACAHNPTGVDPTEEQWREISQLFKAKKHFAFFDMAYQGFASGDPARDAKSIRIFLEDGHHIGISQSYAKNMGLYGQRVGCLSVLCEDPKQAVAVKSQLQQLARPMYSNPPLHGAQLVSTILEDPELKSLWLKEVKVMADRIIGMRTTLRESLEKLGSPLSWEHVTKQIGMFCYSGLTPEQVDRLTSEYHIYMTRNGRISMAGVTTGNVGYLANAIHEVTKSS

SEQ ID NO: 115 - DNA, 1731 bp, Citrus sinensis
ggggggggggggaggggggggccccccgcattcgaggtccgttgcaacaacttggaacgccgcccaataaacacctgacttggcagttggcacatcctcaaagccaagtatattaccaaaatctttcatcgcttattcttttaagattagagcgaaagaagaagaaaaatccaattcatttacatgggcgatgcggagcttgatatcggagcgggtctcgtgtcggagctctgttttaggagctagatggatgtcgtcgtggtggcggaacgtggagcccgctcctaaggatccgattctcggcgtcactgaagctttcttggcagatcccagtcctgataaagtcaatgttggagtcggagcttatcgagatgataatggaaagccagttgttcttgaatgcgtcagagaagcagagcggagaattgctggaaccgccaacatggagtatcttcctatgggagggagtgtgaaaatggtggaggaaactctgaagctcgcctatggagataattctgagttcatcaaggataaaaggatagcagctgtacaatctctctcagggactggtgcatgccgactttttgcagactttcagaagcgttttcatcctgattctcaaatctacatacctgtcccaacatggtccaaccaccataacatctggagagatgcccatgtcactcaaaggacttttcattactatcaccctgggactaagggtttagattttgcagcactgatggatgacattaagaatgcaccaaatggttcattctttctacttcatgcttgtgctcacaatcccactggagtggatccttcagaggaacaatggaaagagatctcataccaaattaaggcaaaaggtcacttcccattctttgacatggcgtatcagggttttgccagtggtgatccggagagagatgccaaggccatccgaatttttctcaaggatggtcacctacttggattagcccagtcatatgcaaaaaatatgggactctatggccaaagagtaggatgccttagtgtgctatgtgaagatgaaaagcaagcagtggctgttaaaagtcagttgcagcagcttgccaggcccatgtacagcaatcctcctgttcatggtgcactcatagtctcaaccatccttggagatgcagaattgaagaaattatggctcaaggaagttcagggcatggcagatcgcatcattggaatgcgaactgcgcttcgagaaaacctcgagaaattgggatcacccttatcatggaaacacataactaatcagattggtatgttttgctatagtgggttgacgcccgaacaggtggatcgtctaacagatgaatatcacatctacatgacgcgaaatggtcgtatcagcatggccggagtaactacaggcaatgttggatatcttgcaaacgctattcatgaggtcacaaaatctgcttagtttgtttacaaaagctgcatatcaattttgtaggcagccatatatacacaggggcacaatgcaatacaataaatttttgaaatattctttccattcccttcatgactgggggaaagacaattataacggacatcgtttatttttgctctttcacaggagctgctttccctctttttaagtttgttttgtttaggagggaggagagagcctttgaattatctcattcttgtataataaacttctggtcgctactatctatgataccggggcaa

SEQ ID NO: 116 - protein, 422 aa, Citrus sinensis
MRSLISERVSCRSSVLGARWMSSWWRNVEPAPKDPILGVTEAFLADPSPDKVNVGVGAYRDDNGKPVVLECVREAERRIAGTANMEYLPMGGSVKMVEETLKLAYGDNSEFIKDKRIAAVQSLSGTGACRLFADFQKRFHPDSQIYIPVPTWSNHHNIWRDAHVTQRTFHYYHPGTKGLDFAALMDDIKNAPNGSFFLLHACAHNPTGVDPSEEQWKEISYQIKAKGHFPFFDMAYQGFASGDPERDAKAIRIFLKDGHLLGLAQSYAKNMGLYGQRVGCLSVLCEDEKQAVAVKSQLQQLARPMYSNPPVHGALIVSTILGDAELKKLWLKEVQGMADRIIGMRTALRENLEKLGSPLSWKHITNQIGMFCYSGLTPEQVDRLTDEYHIYMTRNGRISMAGVTTGNVGYLANAIHEVTKSA

SEQ ID NO: 117 - DNA, 1766 bp, Glycine max
gctctctccctctctgttcgcactctgtctttcccctgtttccgcgtcactgagtcatggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccacggaaaacctgtggttttggaatgtgttagagaagcagagaggagggttgccggaagtcaattcatggagtatcttcccatgggtggaagcataaaaatgatagaagaatcgctgaagctggcatttggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaccaccataacatttggagagatgctggagtgcctatgaagacattccgttactatcaccctgagtctagaggattggatttttcaggactgatggatgacataaagaatgctccagatggttccttctttctgcttcatgcttgtgctcataatcctactggagtagatccttcagaagaacaatggagagagatctcttcccagataaaggctaagggtcatttccctttctttgacatggcatatcaaggttttgctagtggtgatccagagagagatgcaaaagccataaagatttttcttgaggatggtcatttaataggacttgctcagtcatatgcaaaaaatatgggactgtatggccagcgagcaggaagcctgagtgtgctttgtgaagatgagaaacaagctgtggctgtaaaaagtcagttgcagctgattgctagacccatgtacagtaacccacctctccatggagcacttatagtttctactgtccttggtgatccagatttgaagaagttatggcttaaagaagtcaaggttatggcagaccgcatcatcggaatgaggactacactacgagaaaacttagaaaagaaggggtctactttgccatggcagcatataactaatcagattggtatgttctgctacagtggattgacacctgaacaggttgatcgtatgacaaacgagtttcatatttacatgacccgtaacggtcgtatcagtatggctggtcttaatacgggcaacgttggatatgttgctgacgctatccatgaggttacaaaatcattctagattattcaatcacccaacaggtgaccaaatttttgtctttggagacaaacatctcagaagtagtacccttatccaggggagcaaaataaatttaataaagtctgacaaattttcaacttgtttcggggtaagatagtgatactcttcagggtttaccttgcatattgaagacccttattgcaatacgtatccgatttatcatatccatgcaccatagattatatccatttttacagacatcttgtttagcactttaatgagcataaccctgtatcatcattttttttataaaataatttgagtagtagattgaataagggctttatttatggtgaacaggaagtacgtagcttcattcttactacactattattcctgttagtgaaactttgcgattgttgaagctagaatggatatttaaatgct

SEQ ID NO: 118 - protein, 427 aa, Glycine max
MAIRNSLTGQFLRRSSVAGARLMSSSSSWFRSIEPAPKDPILGVTEAFLADQSPNKVNVGVGAYRDDHGKPVVLECVREAERRVAGSQFMEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLHACAHNPTGVDPSEEQWREISSQIKAKGHFPFFDMAYQGFASGDPERDAKAIKIFLEDGHLIGLAQSYAKNMGLYGQRAGSLSVLCEDEKQAVAVKSQLQLIARPMYSNPPLHGALIVSTVLGDPDLKKLWLKEVKVMADRIIGMRTTLRENLEKKGSTLPWQHITNQIGMFCYSGLTPEQVDRMTNEFHIYMTRNGRISMAGLNTGNVGYVADAIHEVTKSF

SEQ ID NO: 119 - DNA, 1735 bp, Gossypium raimondii
ctggattggattggattggattcgattagcccccctcatttaatcttatttcatttcattgatataaccgagagaaaatcctccgataacgccattgtcgcgcttttcttcactttctgtttcaactacgaacttctttgttggtgactaaatggcgatccgaagagctatgtctggtcgcatcatggatcggacggccgtcgttggtgcgcgatacatgtcatcgtggtggcgtagcgttcaacccgctcccaaggatcctattcttggtgttacggaggcttttttggccgatcaaagtgccgataaagttaatgttggagtcggtgcttaccgtgatgataatggaaagccagttgttttggaatgtgttagagaagccgagcgaaggattgctgggaatttgaacatggaatatcttcctatgggaggaagcgtgaagatggtggaagaaacactgaagttggcctatggtgagaattctgagttgataaaagaaaaaaggatagcagcagttcaagctctgtctgggactggtgcatgccgactttttgcagactttcaaaagcgtttttgtcctgactcccaaatctatataccagtccctacttgggccaaccaccacaacatttggagagatgctcaggtccctcagaaaacctaccattattatcacccagagtcgaagggtctagattttgcagcaatgatagatgacattaagaatgctccaaatggctcattctttctacttcatgcatgtgctcataaccccactggtgtggatccttcagaggagcagtggagagaaatctcacaccacatcaaggcaaaaggtcattttgccttctttgacatggcgtatcaaggctttgctagtggtgacccagagaaagatgcaaaggccatcaggatttttcttgaggatggtcatcacataggaattgcacaatcatatgcaaaaaacatgggactctatggccagagggtaggatgcctcagtgtgctttgtgaagatgaaaaacaagcagtagctgtaaaaagtcaactgcaacagcttgcgagacctatgtacagcaacccacctgttcatggtgctctcatagtttcaaccattcttagtgatccagacttgaagaaacaatggctgaaagaagttaaggtcatggctgatcgcataattggaatgcgaactgctttacgagggaaccttgaaaagctcggttctccattatcatggcagcacattactaatcagataggaatgttttgctatagtgggttgacaccagaacaagtggatcgcttgacgaacgaatttcacatctatatgactcgcaatggtcgaatcagtatggctggtgttacaacgggcaatgtcgaatatttggcaaatgcgattcatgaagtcacaaaatgaggttagaatcatagctgatattgatccttcaaaagatttttggtgtgtttgtaaggacaattaaaggagcattgatagaagctgaacttaaggtttctgcattgaataaatactatgactagaataggaaagaggtaaagattggatctgtacctgatttggcctacaaaggatggatagttcatttccttactagttacaacttttaataattcaagcaactcgtatgtatctttgcttgagaaacaaaacaatgtaactaattaatgccaattccgttcatttctctatggtaggtaggttaaaattcccagc

SEQ ID NO: 120 - protein, 422 aa, Gossypium raimondii
MAIRRAMSGRIMDRTAVVGARYMSSWWRSVQPAPKDPILGVTEAFLADQSADKVNVGVGAYRDDNGKPVVLECVREAERRIAGNLNMEYLPMGGSVKMVEETLKLAYGENSELIKEKRIAAVQALSGTGACRLFADFQKRFCPDSQIYIPVPTWANHHNIWRDAQVPQKTYHYYHPESKGLDFAAMIDDIKNAPNGSFFLLHACAHNPTGVDPSEEQWREISHHIKAKGHFAFFDMAYQGFASGDPEKDAKAIRIFLEDGHHIGIAQSYAKNMGLYGQRVGCLSVLCEDEKQAVAVKSQLQQLARPMYSNPPVHGALIVSTILSDPDLKKQWLKEVKVMADRIIGMRTALRGNLEKLGSPLSWQHITNQIGMFCYSGLTPEQVDRLTNEFHIYMTRNGRISMAGVTTGNVEYLANAIHEVTK

SEQ ID NO: 121 - DNA, 1718 bp, Hordeum vulgare
cgcgtccgccggcccgccgcaaccagcacgcagatttccttcctacctttcccctcccctcccatcccctcccctgctccggcgaccggcaagccggccaagaagcccaacgcttacccctcaagccggatccgccatggcgctgtaccgccgcgcggcctccgcgatccggcggcgcggggccgcgcctctccccatgctcccggcgcgggccatggcgtcgctcttcggccacgtcgagccggcgcccaaggaccccatcctcggcgtcaccgaggccttcctcgccgacccctcccccgacaaagtcaacgtcggcgtcggcgcctaccgggacgacgacggcaggcccgtcgtgctcgactgcgtgcgcgaggcggagcgccggatcgccggcaacctcaacatggagtaccttcccatgggagggagtatccacatgattgaagagtcgctaaagctggcgtatggtgaggactccgagttcatcaaagataaaagaattgcagcggtgcaggcactttcaggaactggcgcatgccggctcttcgctgatttccagaagcgtttcctgccggattcgcagatctacatacctacaccaacgtggtccaaccatcataatatttggagggatgctcaagtgccgcagaggacattctcatattaccacccggaatcgagagggcttgactttgcaggattgatggatgatatcaagaatgctccaaatggttctttctttttgcttcatgcatgtgcccataatcctactggagtagatcccactgaggaacaatggcgagaaatatcctatcagttcaagttgaagaaccatttcccattctttgacatggcataccaaggatttgctagcggtgatccagagagggatgccaaggcaatccgtatattccttgaagatggacaccaaattggatgtgctcagtcatatgcaaagaacatgggtctttatggacagagagcgggatgcctgagtattctctgcgaggatgagatgcaagcagttgctgttaagagccaattgcaacagattgcgagaccaatgtacagcaacccacctgttcatggtgcgctggttgtttctattatccttaatgatccagaattgaagaacttatggttgggagaggtcaagggtatggctgatcgtatcattggaatgcggaaggcacttcgggagaatcttgaaaagttaggttcacctttatcatgggagcatgtcaccaatcagattggaatgttttgctacagtgggatgacgcctgaacaagtcgaccgcttgacaagtgaataccatatctacatgacacgcaacgggagaataagcatggccggcgtaacgacgggcaacgtctcctacttggctaatgccattcatgatgttaccaagtgaaatcgaggaccatcttcagcgaatggagcgaaaggggttttccctttgttactggggctattcattctatactgtcatgctagagaaataagttctaggaagtaaacctgttgcggctgtccaacaacggaaaattctacctgtatgtatggagaagcagagacgtcccgacttatttttgccagattatcttattgtgattctagtcacattcgaatgaaacgccagtggaaaatgcttggttataccttgattttaacaagatgctggaggacttcaaactcgacgaaatcaaacattg

SEQ ID NO: 122 - protein, 426 aa, Hordeum vulgare
MALYRRAASAIRRRGAAPLPMLPARAMASLFGHVEPAPKDPILGVTEAFLADPSPDKVNVGVGAYRDDDGRPVVLDCVREAERRIAGNLNMEYLPMGGSIHMIEESLKLAYGEDSEFIKDKRIAAVQALSGTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKNLWLGEVKGMADRIIGMRKALRENLEKLGSPLSWEHVTNQIGMFCYSGMTPEQVDRLTSEYHIYMTRNGRISMAGVTTGNVSYLANAIHDVTK

SEQ ID NO: 123 - DNA, 1646 bp, Hordeum vulgare
cggcacgaggctcttctccagcagagcggcagcctcgccacgcgccgcgcgcgcgcagcaaccggcatggcgatgtctcgcgccgccgcggccgtccggcagcgccgacgcgtgccgctcctgcccgcggcgaggtccatggcgtcgtggttcgggcacgtggagccggcccccaaggaccccatcctcggcgtcaccgaggccttcctcgccgacccctcgccggacaaagtgaacgtcggcgtcggcgcgtaccgggacgacgccgggaagcccgtggtgctggagtgcgtgcgcgaggcggagcggcgaatcgccgggagcaccaacatggagtaccttccgatgggaggaagcgtgaagatgattgaggaatcgctgaagctggcatacggggaggattctgagttcatcaaggacaagaggatcgcggcagtgcaggctctttcggggactggtgcatgtcgcctctttgcagatttccagaagcgcttcttgcccgattcacacatctacattcctactcctacatggtcaaaccatcacaacatttggagggatgcccaggtaccacaaagtgcatttgcctactaccatccagaatcaagaggactggactttgcaggcctgatggatgatatcaagaaagctccagagggttccttctttttgcttcatgcatgtgctcacaatcccacgggggttgatccttctgaggaacaatggagagagatatctcaacagtttaaggtgaagaaccatttcccatttttcgacatggcataccaaggatttgctagtggtgacccagagagagatgccaaggctattcggatctttcttgaagacggacaccaaattggatgtgcacagtcgtatgcaaaaaacatgggactttatggccaaagagcaggatgccttagtatcctctgcgacgatgaaatacaagcagttgctgtgaagagccaattgcaacagattgccagacctatgtacagcaacccaccccttcatggcgcactaattgtttccactatccttggggatccagcactgaaaagcttatggctcaaagaggtcaagggtatggctgatcgcattattggaatgcgaaaagcacttaaggatagtcttgaaaagttgggttcaccattatcatgggaacatattactaatcagattggtatgttttgctacagcgggatgacgcctgaacaagttgatcgcttaacaaatgaattccacatatacatgactcgtaatggcaggataagcatggctggtgtgacaacaggaaatgtcgcctatttggctaacgctattcatgaggtcactaagccaaattaagacatgttcctccggccattttgagaaataagaggagcctttcaacttcaagttgcaatttgcttttaatttcctttaaccttttctgaccatgatatggtcaggtagacaaataagtatgttccaatactgttgtttttctcaaagaatgtatcatattgttgtgacctatgggtgtgcaaatattgatttgtttcactgcaggcacataaaggaacactttttgtaagaactagaatgatcctatattacagttgcaaatgatgccctaacacagaaaatgtcatcattttaaaaac

SEQ ID NO: 124 - protein, 426 aa, Hordeum vulgare
MAMSRAAAAVRQRRRVPLLPAARSMASWFGHVEPAPKDPILGVTEAFLADPSPDKVNVGVGAYRDDAGKPVVLECVREAERRIAGSTNMEYLPMGGSVKMIEESLKLAYGEDSEFIKDKRIAAVQALSGTGACRLFADFQKRFLPDSHIYIPTPTWSNHHNIWRDAQVPQSAFAYYHPESRGLDFAGLMDDIKKAPEGSFFLLHACAHNPTGVDPSEEQWREISQQFKVKNHFPFFDMAYQGFASGDPERDAKAIRIFLEDGHQIGCAQSYAKNMGLYGQRAGCLSILCDDEIQAVAVKSQLQQIARPMYSNPPLHGALIVSTILGDPALKSLWLKEVKGMADRIIGMRKALKDSLEKLGSPLSWEHITNQIGMFCYSGMTPEQVDRLTNEFHIYMTRNGRISMAGVTTGNVAYLANAIHEVTKPN

SEQ ID NO: 125 - DNA, 1388 bp, Ostreococcus lucimarinus
ccggcgcgctcgggccggcgcatgctcgcgcgcgcgaccgcgcagatcgtgcaccgccgcgcgcgcgacgcgggcgccgcgctcgcgaagcgaacgttgggaaaagaaataagcgcgacgcgtcgaagcgaccgcacgacgacgacgacgcgcgcgatgtcgcgattcggggacgtcccggaagcgccgaaggacccgatcctggggatttcggagatgtttaacgcggacgcgcacgcggagaagatgaatctcggggtgggggcgtatcgggatgataacggtaagcccgtggtgttgaattgcgtgcgcgaggcggagaagcgcatcgcggggaactttaacatggagtatttgcccacgaacgggtcgaaggatttcgttcagcagtctttgaaattggcgttcggggagaattccgcgcacgtcgccgacggtagcatcgccgccgttcagtcgttgtctggcacgggctcgtgccggttgatggcggagttccaacggcgattcatgccgggctgcaaggtgtacatcaccgtgccgacgtggagtaatcaccacaacatttggcgcgacgccgggtgcgaacaagacacgtttcgttattacaaggaatcaacgcgcgggctcgatttcgaagggatggtcgaagacatccaaaacgccccggacggaagcatgttcttgttgcacgcgtgtgcgcacaatccgactggcgtcgatccttcggcggagcagtggcgcgaaatttccaaagtcatgaaggcgaagaatcacttcgccttcttcgacatggcgtaccaaggcttcgcctcgggcgattgtgaacgtgatgcgcaagcgatcagaatctttgttgaagacggacataaggtcgcgctcgcacaatccttcgcgaagaacatgggcttgtacggccaacgcatcggcaccgtgagcgtgatgtgcaaagataaggaagaagccaaccgtgtcgagtcgcaactcaaggtgatcgcgcgtgcgatgtactcgaacccacccatgcacggtgcgctcatcgcttccacgattctcggcgatgccgcgctcaaggcgcagtggtacgaggaagtgaagggcatggcggatcgcatcatcaaaatgcgaacgctcttgcgtaagaacctcgaagaaagcggttcgacccttccgtggcagcacgtcaccgaccaaatcggtatgttctgcttcagtgggatgactggcgagcaagtggataaattgcgaaccgaccatcacatctacatgactcgtaacggcagaatttctatggcgggcgtgacgagctcgaacgtcggtcgcttagccgcggcgatgcacgaagtgacgaaatagagtttcaataagcacgacgatacgataatcga

SEQ ID NO: 126 - protein, 444 aa, Ostreococcus lucimarinus
MLARATAQIVHRRARDAGAALAKRTLGKEISATRRSDRTTTTTRAMSRFGDVPEAPKDPILGISEMFNADAHAEKMNLGVGAYRDDNGKPVVLNCVREAEKRIAGNFNMEYLPTNGSKDFVQQSLKLAFGENSAHVADGSIAAVQSLSGTGSCRLMAEFQRRFMPGCKVYITVPTWSNHHNIWRDAGCEQDTFRYYKESTRGLDFEGMVEDIQNAPDGSMFLLHACAHNPTGVDPSAEQWREISKVMKAKNHFAFFDMAYQGFASGDCERDAQAIRIFVEDGHKVALAQSFAKNMGLYGQRIGTVSVMCKDKEEANRVESQLKVIARAMYSNPPMHGALIASTILGDAALKAQWYEEVKGMADRIIKMRTLLRKNLEESGSTLPWQHVTDQIGMFCFSGMTGEQVDKLRTDHHIYMTRNGRISMAGVTSSNVGRLAAAMHEVTK

SEQ ID NO: 127 - DNA, 1763 bp, Oryza sativa
atcaaagcgagacaccttttcttttggcctccttcctcgcgaaaaccaccaaaccaaaacccacacacccacagcttttctccccctcactgctttgctctccagtctccacctcctcctcctcgctgccgcgccgcccatccgccagccatggcgatgtcgtcgtcccgctcggcggccgcgatccgggggcggcgggtcggggcgctggcgagggcgaggaggcacgcgacgagggcgatggcgtcgctgttcggccacgtcgagccggcttccaaggaccccatcctcggcgtcaccgaggccttcctcgccgacccctcccccgacaaagtcaacgtcggcgtcggcgcctaccgggacgacaacggcaagcccgtcgtgctcgagtgcgtgcgcgaggccgagcgccggatcgccggcaacctcaacatggagtaccttccaatgggaggaagtataaagatgattgaagagtcactaaagctggcatatggtgaggattctgatttcatcaaagataagaggattgctgcggtgcaggctctttcaggcacaggtgcatgccggctctttgccgatttccagaggcgtttcttgccaaattcacagatctacatacctacacctacatggtccaatcatcataacatttggagggatgctcaagtacctcaaaggacattcacctattaccatccagagtcaagagggcttgatttcgcaggactgatggatgatattaagaacgctccaaatggttcattctttttgcttcatgcttgtgcccataatcctactggagttgatcctacagaagaacaatggagagagatatcctaccaattcaagataaagaatcatttcccattctttgacatggcataccaaggatttgccagcggtgatccagagagagatgctaaggcaatccgaatcttccttgaagatgggcatcaaattggatgtgctcagtcatatgcaaagaacatgggactgtatgggcaaagggcagggtgcttgagtattctgtgtgaggatgagatgcaagcagtttctgttaagagccaattgcaacagattgcaaggccaatgtacagcaacccacctgttcatggtgcactggttgtctccataatccttaatgatccagaattaaagagtttatggttgaaagaggtcaagggtatggctgatcgaatcattggaatgcggaaggcactccgggaaaatctcgaaggcctaggttcaccattgtcatgggatcacatcaccaatcagattggaatgttctgctacagtgggatgacacctgaacaggtggatcgcttaaccaatgaataccatatttacatgacccgtaatggcagaataagcatggctggtgtaacaacaggaaatgtggcgtatttggctaatgctattcatgaggtcactaaaacgaaatgaagctacttcctcttccctcttcggccaatgaaatgaggcttgcaagcggcggcgttttttttttggggggtggtctattgacctttaagatggttgtactagagaaataatccagtgaacatgctggtgtttctccaacttcggattttccctgtatggaggagagaactagaaacctacccaattttgagagctatagatgccgatcctgttatttcaatcgtcagatgttatgcctgtggcagcctggcaggtcacctcagaaacagagatatgtgaaagagaataaatgcaaatgagctgagcattttgac

SEQ ID NO: 128 - protein, 432 aa, Oryza sativa
MAMSSSRSAAAIRGRRVGALARARRHATRAMASLFGHVEPASKDPILGVTEAFLADPSPDKVNVGVGAYRDDNGKPVVLECVREAERRIAGNLNMEYLPMGGSIKMIEESLKLAYGEDSDFIKDKRIAAVQALSGTGACRLFADFQRRFLPNSQIYIPTPTWSNHHNIWRDAQVPQRTFTYYHPESRGLDFAGLMDDIKNAPNGSFFLLHACAHNPTGVDPTEEQWREISYQFKIKNHFPFFDMAYQGFASGDPERDAKAIRIFLEDGHQIGCAQSYAKNMGLYGQRAGCLSILCEDEMQAVSVKSQLQQIARPMYSNPPVHGALVVSIILNDPELKSLWLKEVKGMADRIIGMRKALRENLEGLGSPLSWDHITNQIGMFCYSGMTPEQVDRLTNEYHIYMTRNGRISMAGVTTGNVAYLANAIHEVTKTK

SEQ ID NO: 129 - DNA, 1670 bp, Oryza sativa
gcgatgcacacacgcagccgtcggcttggtttcccccccctgaatccaagtcacctcctcctcacacctcaccttccccctctctcctccgatcgcgcgcgcatggcgatgtcacgagccgccgccgctgccgcggggactcccgtggcgcggcggcgattgatgggggccgtggcggcgaggtcgatggcgtcgtggttcggccacgtggaaccggccgccaaggaccccatcctcggcgtcaccgaggcgttcctcgccgacccctccccggacaaagtcaacgtcggcgtcggcgcgtaccgggacgacagcgggaagcccgtggtgctggagtgcgtgcgcgaggcggagcggcggatcgccgggagcatgaacatggagtaccttccaatgggtggaagcataaagatgattgaagaatcacttaaactggcctatggggagaactgtgagttcatcaaggacaagaggatcgcagcagtgcaggctctttcaggaactggtgcatgtcgcctctttgcagatttccagaagcgtttcttgccagattcacagatttatatacccacacctacatgggccaaccatcacaatatttggagggatgcccaagtaccacaaaagacatttacctattaccatccagagtcaagaggacttgactttgcaggcctaatggatgatatcaagaatgctccagatggttcattctttttgcttcatgcttgtgcgcataatcccactggagtagatccttcagaagaacaatggagggagatatctcatcagttcaaggtgaagaaacattttccattcttcgacatggcataccaaggatttgctagtggtgatccagagagagatgccaaggcaattcgaatatttcttgaagatggacatcaaattggatgtgcacagtcatatgcgaaaaacatgggactttatggacaaagagcaggatgccttagtattctatgtgatgatgagatgcaagcagttgctgttaagagccagttacaacagattgctagacctttgtacagcaacccacccgttcatggtgcattaattgtttcaactattcttggtgatccggagttgaaaagtttatggctgaaagaggtcaagggtatggctgatcgtatcattggaatgcgaacagcactcaaagagaaccttgaaaagttgggttcaccaatgtcatgggaacatatcactaatcagattggaatgttctgctacagtggtatgacacctgaacaagtcgatcgcttgacaaaagagttccatatctacatgactcgtaacgggcggataagcatggctggagtaacaacaggaaatgttgcctatctggctaatgctattcatgaggttaccaagacaaagtgagagtgttggagacattcctatcatcattttcagtacctttttaccgaccgcaaaatgggtcaaatggtgaaataaaattgtagtccgatatgatgtgaaataaaatggctggtaagctagaaaagggcaagtttattttttgaggacaagacttttgctgtaccagtgaaaacattttttaggacaagactttacagttagaacgaacgttctaactgtgacagtgtcatgctttgtaaaggaagtgtacctttccaccgatgggcatttttgat

SEQ ID NO: 130 - protein, 463 aa, Oryza sativa
MHTRSRRLGFPPLNPSHLLLTPHLPPLSSDRARMAMSRAAAAAAGTPVARRRLMGAVAARSMASWFGHVEPAAKDPILGVTEAFLADPSPDKVNVGVGAYRDDSGKPVVLECVREAERRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 131 - DNA, 1206 bp, Ostreococcus taurii
atggcgcggttcgccgacgtcccggaggcgccgaaggacccgatcctggggatcagcgagttattcttggcggatacgtcgagcgacaagatgaatctcggggtggtgcgtggtgcgtatcgggatgataatggtaagcctcaggtgctgaagtgcgttcgcgaggcggagaagcgaatcgcggggaactttaatatggagtacctgccgacgaacggcttcaaggatttcatcaagcactcgctcgatctggcgtacggtgaagattctgaggccgtgaagagcgggtccatcgccgcggtgcaatcgctctccggtaccggttcttgtcgtcttctcgcggagtttcaaaagcgattcatgccgggatgcacggtttacatcagtgtcccgacgtggagcaaccaccacaacatttggcgcgacgccgggtgcgagcaaaccacgtaccgttactacaaggaatccacgcgtggtcttgatttcgagggcatgatggaagacatcaacaacgcgccgaatgggagcatgttcctcctgcacgcgtgcgcgcacaacccgaccggcgtcgatccgtcggcggagcagtggcgcgaaatttccaaggctatgaaggcaaaaaaccacttcgcgttcttcgacatggcctaccaaggttttgcgtccggcgactgcgtgcgagacgcgcagtcgattcgcatcttcgctgaggatggtcacaagttcgccctcgcgcagtcctttgcgaagaacatgggcttgtacggtcagcgcatcggtaccgtgagcgtcatgtgcgaggacaaggctgaggccgtccgcgttgagtcacagctcaaggtcatcgctagagcgatgtactcgaacccgccaatgcacggtgcactcatcgcgtcgacgatcctcggcgatcctgcgctcaaggcgcagtggtacgtggaggtgaaggagatggctgaccgcatcatcaccatgcgaacgctccttcgcaagcatctcgaagactccggatccaagctgccttggcaacacgtcaccgatcaaatcggtatgttttgctacagcgggatggcgccggagcaagtggacaagctgcgaaccgaccatcacatttacatgacgcgcaacggacgcatctccatggcgggcgtgacgagcggaaacgtcgagcgcttggccaaggcgatgcatgaggtgacgaagtag

SEQ ID NO: 132 - protein, 401 aa, Ostreococcus taurii
MARFADVPEAPKDPILGISELFLADTSSDKMNLGVVRGAYRDDNGKPQVLKCVREAEKRIAGNFNMEYLPTNGFKDFIKHSLDLAYGEDSEAVKSGSIAAVQSLSGTGSCRLLAEFQKRFMPGCTVYISVPTWSNHHNIWRDAGCEQTTYRYYKESTRGLDFEGMMEDINNAPNGSMFLLHACAHNPTGVDPSAEQWREISKAMKAKNHFAFFDMAYQGFASGDCVRDAQSIRIFAEDGHKFALAQSFAKNMGLYGQRIGTVSVMCEDKAEAVRVESQLKVIARAMYSNPPMHGALIASTILGDPALKAQWYVEVKEMADRIITMRTLLRKHLEDSGSKLPWQHVTDQIGMFCYSGMAPEQVDKLRTDHHIYMTRNGRISMAGVTSGNVERLAKAMHEVTK

SEQ ID NO: 133 - DNA, 2130 bp, Physcomitrella patens
gcggtgacccgatcaccgagttcgtagtttccacgggtcttatcaggatggtcgttgctggcaagcgacgtcacgggttctcgttcgtcggggaagagaaattctcgtcgacgagggtgggggggggacgatcctcgttgttctagagaacgagagccgacgaacgaagcccgtaaggctgaggtcaggcaccgtcttgcacccggactgggacggcgcctcaggagcgccttgctcttgtcgtcatcccctgcgagaccccctgttttcacgagccttctgcccccgccgttgcaggggtcgccgttttgttccgctcggcgcctcttcctgcctgcattgggctttctatcgagctttggatgttcttttgagctgcagtgttcaggggcttctcatcgctcgtctcgtctcgcctgcgtgaggaagcttagttgattggattttgcaaagatggcgggtgcgatggccgctcggagcagcaggcgcttcatgagcactgcctccaaatcgtggttcgggcatgtgcagcccgcgcccaaggaccctatcctgggcgtcacggaggcgtttctcgctgattctcacccggataagatgaacgtcggcgttggggcgtaccgtactgatgagggcaaaccattggtattggaatgcgtgcgtaaagctgaagaaaagattgccggttccaacttcatggagtaccttcccatggggggtgatatctctttcaacaatcatagcatgaagttggcttacggagaagatgctggcgtattagctgacaaaagagtggctgccgtccaagccctatcaggaactggtgcatgccgtctcttcgccgacttccaaaagcgattcatgccagagtctcaagtttttatccccgttccaacgtggtccaaccatcacaacatctggagggatgccaacgttcctcagaacactttccgttactatgacgcagctaccaagggcctcgacttcaagggcctcatggaggatgtgaagaaagctcccaatggttcagttttcctattgcacgcttgtgcacacaacccgactggtgtagacccatctccagagaactggaaggagatttctgcattttttaaggaaaaaggccatttcgccctttttgacatggcataccaagggtttgcttccggtgatacggaaagggacgcccaggctatccgcattttcttgaacgatggtcatcaaattgcatgtgcacagtctttcgcaaagaacatgggtctttatggccagcgtgttggatgtctcagtgttgtgtgcgacgatcctcaacaagcagttgccgtgaagagtcagttgcagctgattgctcgccctatgtactccaaccctcccttgcatggtgctttgcttgtgtccaccattttggaggaccctgaacttaagtccctctggtacaaagaagttaagggaatggctgaccgtatcatcggcatgcgtgagacactccgtaccaatcttgagaaggctggatctcagcacagctggaagcatatcactgatcagattggtatgttttgcttcagcggtttgaagcctgagcaagtagatcgtttaacgaaggatttccatatctacctcacacgcaatggccgcatcagtatggccggtatcactacttccaatgtggaatatcttgctaatgccatccacgaggtttccaagaactaggaggtttccaaggactaggaggttgagaaagcttgagattttccaagccacattggttagttacagagcgaggtttgtgtaccattccttcttgcatacatgtgcatgagttttttttctcagtatagcaaaaggaatcgacgagcagcattgataaccatttttggaactgatcagaagagagaaataagcgcaggcctgttggagtctggccccacacgggattcaccctccatttagttcttgggctacaaatctagagtagacccaatatacattgtgttgtttctggagtgaatatcaggaaacactagtcttcttttgtcagtgttgagttatttcgacaaggtgccgttctctggcaaatcacggactgcttgtattttgcgctatgtttcatgaaattacttcttggcactc

SEQ ID NO: 134 - protein, 418 aa, Physcomitrella patens
MAGAMAARSSRRFMSTASKSWFGHVQPAPKDPILGVTEAFLADSHPDKMNVGVGAYRTDEGKPLVLECVRKAEEKIAGSNFMEYLPMGGDISFNNHSMKLAYGEDAGVLADKRVAAVQALSGTGACRLFADFQKRFMPESQVFIPVPTWSNHHNIWRDANVPQNTFRYYDAATKGLDFKGLMEDVKKAPNGSVFLLHACAHNPTGVDPSPENWKEISAFFKEKGHFALFDMAYQGFASGDTERDAQAIRIFLNDGHQIACAQSFAKNMGLYGQRVGCLSVVCDDPQQAVAVKSQLQLIARPMYSNPPLHGALLVSTILEDPELKSLWYKEVKGMADRIIGMRETLRTNLEKAGSQHSWKHITDQIGMFCFSGLKPEQVDRLTKDFHIYLTRNGRISMAGITTSNVEYLANAIHEVSKN

SEQ ID NO: 135 - DNA, 1812 bp, Picea sitchensis
ggagattgcgccattagcttattgcacaggagtaacagaaaggaggaaatcatggccatggcgatggcgatgagcagatccaatgcgggaaggggcataagattgatgtccacttcaggatggtggaaagctgtggagccagctcccaaagaccctattctcggagtcaccgaagcctttttagcggatacagatcctaacaaggtcaatgttggcgtgggtgcttatcgcgatgatcaagggaagccagtggttcttcaatctgtgcgtgaggccgagcgtcgtattttgggcaaagaaaacatggaatatctacccatgggagggagtgtgaagatggttgaagaatctatcaaacttgcatatggagaaaatgcagatgtcttgaaagataagcgtgtcgcagctgtccaagctctatctggcactggtgcttgccgtctttttgcagagtttcagaagcgttttcgacctgagtctcagatttacataccagtccctacctgggccaatcaccacaatatctggagagatgccaatgtaccgcagaggactttccattattaccatccagagactaggggtttagactttgcatctctcatggatgatgtgaagaatgctcccaatggttcctttttcttgcttcatgcatgtgctcacaatcccacaggtgtagatccaacagaggagcaatggaaggaaatttcttatcaattcaaggtgaaaaatcattatcccttctttgacatggcttatcaaggttttgcaagtggtgatactgacagagatgctaaggcaatcaggatattcttggaggatggtcaccagattgcatgtgcacaatcttttgcaaaaaatatgggcttgtatggacagagggtaggttgtctaagtgttatatgcgatgatgcaaaacaggcagttgcagttaagagccagcttcaacagattgctcggccaatgtacagcaatccacctgttcatggggctcttcttgtatattccatcctgagtgatccagatctcaaggctctctggcacaaggaggttaaggttatggcagaccgcattattggaatgagagaagctttgcgaggcaaccttgaaaatctggggtctcctctcagttggaaccacgttactgaccagattggaatgttttgctatagcggtatgactccagagcaagttgaccgtttgacgagtgaatttcatatttatttgacacgaaatggccgcataagtatggcaggtgttactacaggcaatgttgaatacttggcaaatgctatccacgaggtcacaaagtcatcagaaaaagagctaaaagctggtgcagtttaactctaatttttggcaaagatctatcacaattttattattgcatgatatatgagaattatagggcttagtttgatttttgtgctagtgcaccactattggatatacctttgaataagtggcctattgttcaggcatagtcattaacaaacttaacttttgtactccatttaaggggtgcagtcggtttctcatgaaagtgtaggataaacatttgctggtgcaccactattggagatacctttgaataagtggcctattgtgtaggcatagttattaacaaacttaggttttgtattccgtttaaggggtgcagtcggtttctcatgaaagtgtaggataagcatttgaggcttttggtggaccttttatggtggtattctgtcaaaagtacagttcacaaacctatgtacttgccgttctcattaagtgcgatgtgattaaattttgaagttcttttgatctagt

SEQ ID NO: 136 - protein, 431 aa, Picea sitchensis
MAMAMAMSRSNAGRGIRLMSTSGWWKAVEPAPKDPILGVTEAFLADTDPNKVNVGVGAYRDDQGKPVVLQSVREAERRILGKENMEYLPMGGSVKMVEESIKLAYGENADVLKDKRVAAVQALSGTGACRLFAEFQKRFRPESQIYIPVPTWANHHNIWRDANVPQRTFHYYHPETRGLDFASLMDDVKNAPNGSFFLLHACAHNPTGVDPTEEQWKEISYQFKVKNHYPFFDMAYQGFASGDTDRDAKAIRIFLEDGHQIACAQSFAKNMGLYGQRVGCLSVICDDAKQAVAVKSQLQQIARPMYSNPPVHGALLVYSILSDPDLKALWHKEVKVMADRIIGMREALRGNLENLGSPLSWNHVTDQIGMFCYSGMTPEQVDRLTSEFHIYLTRNGRISMAGVTTGNVEYLANAIHEVTKSSEKELKAGAV

SEQ ID NO: 137 - DNA, 2015 bp, Pinus taeda
ggacggggcactgcgccattatattattgcacagcaataacagaaaggtaaaaaatcatggcgatggcgattgcgatgagcagatccaatctgggaaggggcataagattgatgtccacttctggatggtggaaaactgtagagccagctcccaaagaccccattctcggagttaccgaagcctttttagcagatacagatcctagcaaggtcaatgttggcgtgggcgcatatcgtgatgatcatgggaagccagtggttcttcaatgtgtgcgcgaggctgagaggcgtattatgggcaaagaaaacatggaatatctacccatgggaggaagtgtgaagatggttgaagattctatcaaacttgcatatggagaaaatgcagatgtcttgaaagataagcgtgttgcagcagtccaagctctatctggcactggtgcttgccgtctttttgcagatttccagaaacggtttcgccccgagtctcagatttacataccggtccctacctgggccaatcaccacaacatctggagagatgcccatgtgccgcagagaactttccattattaccatccagagactaagggtttagactttgcatctctcatggatgatgtgaagaatgctcccaatggttcctttttcttgcttcatgcatgtgctcacaatcccacaggtgtagatccaacagaggagcaatggaaggaaatttcttatcaatttaaggtgaaaaatcactttcccttctttgacatggcttatcaaggttttgcaagtggtgacacggacagagatgctaaggcaatcaggatattcttggaggatggtcaccagattgcatgtgcacaatcttttgcaaaaaacatgggcttgtatggacagagggtaggttgtctaagtgttatatgcgatgatgcaaaacaggcagtggcagttaagagccagcttcaacagattgctcgaccaatgtacagtaatccacctgttcatggggctcttattgtatcttccatcctgagtgatccagatctcaaagctctctggcacaaggaggtcaaggttatggcagaccgtattattggaatgagaaaagctttgcgaggcaaccttgaaaagctggggtctcctctcagttggaaccatgtcactgaacagattggaatgttttgctatagtggtatgactccagagcaagttgaccgcttgacgagtgaatttcacatttatatgacacgaaatggccgcataagtatggcaggtgttactaccggcaatgttgaatacttggcaaatgctatcaacgaggtcacaaagtcatcagaaaaagagatgaaagttggtgcaatttaaatctaattttttgcaaacatcacaattttattactgcatcatcatatgagaattttagatcttagtttgatttttgtgctagtgcactgccattggagacaccttggaataagtagcctattgtttaggcatagtcattagcaaacttagtttttgtactccgttttaggggtacagtaggtttctcatgatagtgtaggattaacgtttgctagtgcactgctattggagatacctttgaataagtggcctattgtttaggcatagtcattaacaaaaatagttttgtactccatttaaggggtgcagtcggtttctcatgaaagtgtaggatacagatttgaggtttttttatggacgtttccttttatcgttgtattctgtcaagagaacaattcacatacctgtgtactttcctttctcaaaaagtgggatgttattaaattttgaagtattttactctacctgcggttctctatttgttggctagagctggaaacttattcagtggtcacaagaggagtgtcatgtctaggagaggagaatgcagatctccttttgagttctttgttatttctgtttaatcataaatgtgaaccaagttgataatgatatctattggttagccttttcttgggtattttaattaaaggagaatggtt

SEQ ID NO: 138 - protein, 431 aa, Pinus taeda
MAMAIAMSRSNLGRGIRLMSTSGWWKTVEPAPKDPILGVTEAFLADTDPSKVNVGVGAYRDDHGKPVVLQCVREAERRIMGKENMEYLPMGGSVKMVEDSIKLAYGENADVLKDKRVAAVQALSGTGACRLFADFQKRFRPESQIYIPVPTWANHHNIWRDAHVPQRTFHYYHPETKGLDFASLMDDVKNAPNGSFFLLHACAHNPTGVDPTEEQWKEISYQFKVKNHFPFFDMAYQGFASGDTDRDAKAIRIFLEDGHQIACAQSFAKNMGLYGQRVGCLSVICDDAKQAVAVKSQLQQIARPMYSNPPVHGALIVSSILSDPDLKALWHKEVKVMADRIIGMRKALRGNLEKLGSPLSWNHVTEQIGMFCYSGMTPEQVDRLTSEFHIYMTRNGRISMAGVTTGNVEYLANAINEVTKSSEKEMKVGAI

SEQ ID NO: 139 - DNA, 1272 bp, Vitis vinifera
atggcgtttagaacgggaatttccagaaggatgatgattaggtcggggtttggacttcgatcgatgtcttcgtggtgggggagcgtggagcccgctgccaaagatcccatccttggtgttactgaagctttcttggccgatcccagtcctgataaagtcaatgttggagttggtgcctaccgcgatgataatgggaagcctgttgttcttgaatgcgttagagaagcagagcggaggatcgccgggaaattaaacatggaatatcttcccatgggaggaagtgtgaacatggttgaagaaacactgaagttggcatatggagagaactctgaattcatcaaagataagcggattgcagcagtgcaggctctctctggaactggtgcttgccgacttttcgcagacttccaaaagcgttttcggcctgactcccaaatttatataccagtcccaacctgggctaaccatcataacatctggagagatgcccaggtccctcaaaggactttccattactatcatccagagacaaagggtttagattttgcatcactgatggatgatgtaaagaatgctccaaatggatcattctttctacttcatgcttgtgctcataaccctactggagtggatccttcagaggaacaatggaaagagatctcataccagttcaaggtcaaaggtcattttgccttctttgacatggcatatcaaggttttgctagtggtgacccagagagggatgccaagtccatcaagattttccttgaagatggtcatctaattggcattgcccaatcgtatgcaaaaaacatgggactctatggccagagagtgggatgcctaagtctgctctgtgaagatgaaaagcaagcagtggctgtcaagagtcagttgcagcagattgctagacccatgtacagtaatccacctgttcaaggtgctctcattgtgtcaactattcttggtgatccagaattgaagaaattatggctcaaggaagttaaggttatggcagatcgcattattggaatgcgaactgctttacgagaaaacctagagaagttggggtcccccctgtcttgggagcacattactaaccagattggcatgttctgctacagtggtttgacacctgaacaggttgatcgaatgacaaatgaatttcatatctacatgactcgcaatggtcgcatcagtatggcaggtattacaactggaaatgtctcatatttggctaatgccatccatgaagtgtcaaaatctgcttag

SEQ ID NO: 140 - protein, 423 aa, Vitis vinifera
MAFRTGISRRMMIRSGFGLRSMSSWWGSVEPAAKDPILGVTEAFLADPSPDKVNVGVGAYRDDNGKPVVLECVREAERRIAGKLNMEYLPMGGSVNMVEETLKLAYGENSEFIKDKRIAAVQALSGTGACRLFADFQKRFRPDSQIYIPVPTWANHHNIWRDAQVPQRTFHYYHPETKGLDFASLMDDVKNAPNGSFFLLHACAHNPTGVDPSEEQWKEISYQFKVKGHFAFFDMAYQGFASGDPERDAKSIKIFLEDGHLIGIAQSYAKNMGLYGQRVGCLSLLCEDEKQAVAVKSQLQQIARPMYSNPPVQGALIVSTILGDPELKKLWLKEVKVMADRIIGMRTALRENLEKLGSPLSWEHITNQIGMFCYSGLTPEQVDRMTNEFHIYMTRNGRISMAGITTGNVSYLANAIHEVSKSA

SEQ ID NO: 141 - DNA, 1284 bp, Vitis vinifera
atgcaaaggaggaggatgatgatcaagtgggcacgtgatactgtgagaagaagattcatgtcaacctcagccgctgccattgattggtgggatcatgtgggtcacgcccctaaggaccccatcatgagtgttactgaggcttttctttctgataccagccccaacaagatcaatcttggagtgggggcttacagggatgatgatggaagacctgtggttcttcagtgcgttagagatggggaggtaaagattgcgggcaccgagttcctggagtcagtttcagcttcagttagttcaaaactagtcgaggagagtgtcaagttgatttatggaaaggaggcagatttcataaaagaaggaagatttgcgggggtccaagctctctctggcactggtgcttgccgtctctttgctgagtttcagaggcgtttctatcctcaatcaagaatatatttacccattccaacttggtccaaccaccataacatctggagagatgcccaagttccagggagaaccttccattactaccatcctgactctaagggattacactttgctgcacttatggacgatatcaagaatgctccagatcgttcctttttcttgctccatccttgtgctcacaacccaacaggggttgacccaactgaggaacaatggagagagatctcaaatcttttcaaggtaaaaaatcattttcccttctttgacatggcttatcaaggtttcgctagtggggaccttgacaaggatgccaaggctatccggatatttcttgaagatggacatttaataggctgtgctcagtcctttgctaaaaatatgggattatatgggcacagagtgggctgtctcagtgttctttgtgtggatgcaaagcaagcagttgcaattaaaagccaactacagcatattactagggcaatgtacagcagccctcctgtccatggcatattactggtttcaacaatcttgagtgacccacatctaaaggagctttggaaaaaagagctgaaggtaatggcaaaccgcattcataggatgcggtccactctacatgaaagtctcaagaagctgggttctcccctaaactgggatcacatgactaaccaggttgggatgttttgcttctctggcttatccccggatcaggttaatagactggtgaaggaattccatatatacatgacttatgatggtcgcataagtatggcaggtgtgactacaagcaatgtgagttacttggcaaatgcaatacatgaagttactaaatttggctga

SEQ ID NO: 142 - protein, 427 aa, Vitis vinifera
MQRRRMMIKWARDTVRRRFMSTSAAAIDWWDHVGHAPKDPIMSVTEAFLSDTSPNKINLGVGAYRDDDGRPVVLQCVRDGEVKIAGTEFLESVSASVSSKLVEESVKLIYGKEADFIKEGRFAGVQALSGTGACRLFAEFQRRFYPQSRIYLPIPTWSNHHNIWRDAQVPGRTFHYYHPDSKGLHFAALMDDIKNAPDRSFFLLHPCAHNPTGVDPTEEQWREISNLFKVKNHFPFFDMAYQGFASGDLDKDAKAIRIFLEDGHLIGCAQSFAKNMGLYGHRVGCLSVLCVDAKQAVAIKSQLQHITRAMYSSPPVHGILLVSTILSDPHLKELWKKELKVMANRIHRMRSTLHESLKKLGSPLNWDHMTNQVGMFCFSGLSPDQVNRLVKEFHIYMTYDGRISMAGVTTSNVSYLANAIHEVTKFG

SEQ ID NO: 143 - DNA, 1344 bp, Aureococcus anophagefferens
atgggctggtcgtcgactgcactcgtgcttgcgctcgtcgcgtgcgccaatgcgctcgtcccgcccgtgcaacgacgcggttccccggcgctcgcatcgacggccacgccgccggagctctcggtgctcgtcgaaggcctcaagccgtcggcgaccgtggaggtccacggcctgaccatgcagctgcgcgccgcgggcgaggaggtcgtgagcctctgcgtcggcgagccggacttcccgccgcccaaggccatcgtcgacgccatcggcgccgcggcgctcgccggcgcgacgcgctacaccgaggtcacgggcacgaaggagctgcgggaagcgatcgcgtcggacctcgcgaagcgcaagggcacggcctacgcgccgacggacatcgtcgtcgccaacggcgccaagcaggccgtctacgaggcgctcctcgcgctcgtcgggcccggcgacgaggtcgtcgtgcccgcgccgtactgggtgtcgtacccgtcgatggtcgagatggcgggcgccgccgtcgtccaggtcgacgcggacatcgccgacggctacaagctcacggccgacgccttgaagagcgtgctgacgccgaagacgaaggcgctcatcttctgcaacccgtcgaacccgacgggcgccgtcgtcgacgaggcgggccagcgcgagctgctcgcggtcttggacgcgcacgaggccgccacgggcaagaaggtctgggtcatcagcgatgagatctacgagcagctccactacgagcccgccacgccccacgcgtccttcgcggcgctcggcgggtcgtcgttcgaccgcaccgtgaccatcaacggcttctccaaggcctacgcgatgacgggcttccgcctcggctacctcgcggcgccccaggccgtcgcccgggcctgcggcaagattcagggccagatcacgtcctgcgcgtcgtcgctcgcgcaggccgcgggcgtcgcggcgctgaacctgcccgccggcgcgctcgacggcgacgtcgcggagttcaagcgccgccgcgacctcgtgctcgcgcagctggaggccatcgcggcgaagcgggggcgcatccgctgcccgccggcgcccgagggcgccttctacgtcttcgtggacgtctcgggcacgctcggcctctcgtgcgacggcgacgccgtcgactcgtcgacgtcgttctgcacggcgctcctggccaagcgcaagctcgccctcgtgcccggcgacgccttcggcgcgcccgacggcgtgcgcatctcctacgcggcgtccgaggcggagctcacgaccgcgctcgcggcgatcgacgcgttcgtcaacgacgactgtaactag

SEQ ID NO: 144 - protein, 447 aa, Aureococcus anophagefferens
MGWSSTALVLALVACANALVPPVQRRGSPALASTATPPELSVLVEGLKPSATVEVHGLTMQLRAAGEEVVSLCVGEPDFPPPKAIVDAIGAAALAGATRYTEVTGTKELREAIASDLAKRKGTAYAPTDIVVANGAKQAVYEALLALVGPGDEVVVPAPYWVSYPSMVEMAGAAVVQVDADIADGYKLTADALKSVLTPKTKALIFCNPSNPTGAVVDEAGQRELLAVLDAHEAATGKKVWVISDEIYEQLHYEPATPHASFAALGGSSFDRTVTINGFSKAYAMTGFRLGYLAAPQAVARACGKIQGQITSCASSLAQAAGVAALNLPAGALDGDVAEFKRRRDLVLAQLEAIAAKRGRIRCPPAPEGAFYVFVDVSGTLGLSCDGDAVDSSTSFCTALLAKRKLALVPGDAFGAPDGVRISYAASEAELTTALAAIDAFVNDDCN

SEQ ID NO: 145 - DNA, 1744 bp, Arabidsopsis thaliana
attttcttaacattgttccaccaactcctcccacattctctccgcctctctcgtttacaaatcccacctcaaaggtcgactctttatctctcttctcaccaacccaacttctccaatggcttctcagagttcagtcgccgtcatttcctccgccgccgccagaggtgaatcattcccagattcaaagaaaccaatcgggtcagttcggttccaacaacccctccgtctctccttctcgtactgtaagtcagggaatatgtcatctagaatctgcgctatggccaaaccaaatgatgctgagactctttcatcatcagtagatatgtcacttagcccgcgagttcagtccttaaaaccttccaagactatggttataaccgatcttgcagccactcttgttcaatccggtgttccggttattagactagctgcgggagaacccgatttcgacactcccaaagtcgtagctgaggctgggatcaacgcgattcgagaaggttttactaggtatacgttaaatgcaggtattacagaactcagagaagcaatatgtcgaaagctaaaagaggagaatggattgtcttatgcgcctgatcagatcttggttagtaatggagctaaacaaagtctcttacaagcagtgcttgcagtttgttctcctggagatgaagttataattcctgcaccgtattgggtgagttacacagaacaggcgagattggctgatgcaacgcccgtggttattcctaccaagatttctaacaattttttgttggatccaaaggatcttgagtctaaattgactgaaaaatctagacttcttattctctgctctccttccaaccctactggatctgtttaccccaagagtttgctcgaagagattgcacggatcattgctaagcatccaagacttctggtgctttcggatgaaatatatgaacacattatttatgcacctgcaacacacacaagctttgcttctttgcctgacatgtatgaaagaactttgacagtaaacggtttctcaaaggctttcgcaatgacgggttggaggcttggatatcttgctggtcctaaacatattgtggcagcttgcagtaaattacaaggccaggttagttcaggagctagtagcattgctcagaaagcaggtgttgctgcgcttgggttaggcaaagctggaggagaaacggttgcagagatggttaaagcttatagagaaagacgagatttcttggttaaaagcttaggtgatatcaaaggtgttaagatctctgaacctcagggagctttttatctctttattgacttcagtgcttactatggatcagaagctgaaggttttggtttgatcaatgattcgtcgtctcttgcactatactttcttgacaagtttcaggttgcaatggttcctggtgatgcttttggagatgatagttgtatccgaatatcttatgccacatctctcgacgttcttcaagcagctgttgagaagatcaggaaagcccttgagccactccgtgccactgtctccgtttaacagttcggacacagaaatgtgtttaagattgtttatgatatgttgtaacttatttatcagctttgtctccaatccaataaaaagtctttttctatgctttgttcgttccttcaaattcatatataaccataaacaattatcttaattgtaaatcatttattagtatttaaggttgcttgtgtaataaggttatatccgatt

SEQ ID NO: 146 - protein, 475 aa, Arabidsopsis thaliana
MASQSSVAVISSAAARGESFPDSKKPIGSVRFQQPLRLSFSYCKSGNMSSRICAMAKPNDAETLSSSVDMSLSPRVQSLKPSKTMVITDLAATLVQSGVPVIRLAAGEPDFDTPKVVAEAGINAIREGFTRYTLNAGITELREAICRKLKEENGLSYAPDQILVSNGAKQSLLQAVLAVCSPGDEVIIPAPYWVSYTEQARLADATPVVIPTKISNNFLLDPKDLESKLTEKSRLLILCSPSNPTGSVYPKSLLEEIARIIAKHPRLLVLSDEIYEHIIYAPATHTSFASLPDMYERTLTVNGFSKAFAMTGWRLGYLAGPKHIVAACSKLQGQVSSGASSIAQKAGVAALGLGKAGGETVAEMVKAYRERRDFLVKSLGDIKGVKISEPQGAFYLFIDFSAYYGSEAEGFGLINDSSSLALYFLDKFQVAMVPGDAFGDDSCIRISYATSLDVLQAAVEKIRKALEPLRATVSV

SEQ ID NO: 147 - DNA, 1691 bp, Brassica napus
ccggaatttccgggtcgacgatctcgttctcgtctacatattccccctaaagctcgactctttcaccaacccactttctccaaatgtctactcagacctccgccgccgtcatttcctcctccgtcgccgccgctagagtcgaaccatacccagattcaaagaagccaatcgggtcaatccgtttccaacctcttcctctctccctctcgtactgtagtaagtcagggaaggtttcatctagaatctgcgccatgtccaaaccaaatgatgcagagactctctcttcagtagatacttcacttagccctcgtgtcaaatccttgaaaccttccaagaccatggtcataaccgatctcgccgcaactctggttcagtccggtgttcccgttgtcagactagctgctggagaacccgatttcgacactcctaaaatcgttgctgaggctgggatcaacgcgattcgagatggtttcactaggtattcgctgaatgcaggtattacagaactcagagaagctatatgtcggaagctaaaagaggagaatggattgtcttatgcaccggatcagatcttggttagtaatggagcgaaacaaagtatcttacaagcagtgcttgcagtttgttctcctggtgatgaagttataatccctgcaccgtattgggtaagctacacagaacaggcgagattggctgatgcaacacctgtgattattcctacaaagatctctgataacttcttgttggatccaaaggttcttgagtccaaactgactgagaaatctagacttcttatcctctgctctccttctaaccctactggttctgtttaccccaagagtttgcttgaagagattgcacggatcattgctaaacacccaaggcttatggtgctatcagatgaaatatatgaacatattatatatgcgcctgcaacacacacaagctttgcttctttgcctaacatgtatgaaagaactttgacagtaaacggtttctctaaggcttttgcaatgacgggttggaggcttggatatcttgctggtcctaaacatatagtggcagcttgcagtaaattacaaggccaggttagttcaggagctagtagcatttctcagaaggcaggtgttgctgcacttgggttaggaaaagccggaggagagattgtagctgagatggtgaaagcatacagagagagacgtgatttcttggttaaaagcttccgtgaaatggaaggtgttaagatctctgaacctcagggagctttttatctctttattgacttcagtgcatactatggatcagaagctgaaggttttggtttgatcagtgactcatcctctcttgctttatactttcttgacaagtttcaggttgcaatggttcctggagatgcgtttggggacgatagttgtattcggatatcatacgccacatctctcgatgttctacgagtcgcagttgacaagatcaggaaagcccttgagcccctgcgtgccactgtttctgtgtaacggttcggacagtaacgtgtgttttaagcgtttatgtgatgttgtataaactatatatgtatccactttgtcttacgctttgcccccttcaagttcatgtagccctcaaccatgttcttcattgtacatcaatttaaagcccgaagtagaagcttgtgtgtgtcgtgcacaaaaaaa

SEQ ID NO: 148 - protein, 476 aa, Brassica napus
MSTQTSAAVISSSVAAARVEPYPDSKKPIGSIRFQPLPLSLSYCSKSGKVSSRICAMSKPNDAETLSSVDTSLSPRVKSLKPSKTMVITDLAATLVQSGVPVVRLAAGEPDFDTPKIVAEAGINAIRDGFTRYSLNAGITELREAICRKLKEENGLSYAPDQILVSNGAKQSILQAVLAVCSPGDEVIIPAPYWVSYTEQARLADATPVIIPTKISDNFLLDPKVLESKLTEKSRLLILCSPSNPTGSVYPKSLLEEIARIIAKHPRLMVLSDEIYEHIIYAPATHTSFASLPNMYERTLTVNGFSKAFAMTGWRLGYLAGPKHIVAACSKLQGQVSSGASSISQKAGVAALGLGKAGGEIVAEMVKAYRERRDFLVKSFREMEGVKISEPQGAFYLFIDFSAYYGSEAEGFGLISDSSSLALYFLDKFQVAMVPGDAFGDDSCIRISYATSLDVLRVAVDKIRKALEPLRATVSV

SEQ ID NO: 149 - DNA, 1305 bp, Chlamydomonas reinhardtii
atgtctgccgctgctgcgcctgctggcgctgttaaggtggacacaacgttgaacccgctggttgcatccgtgaagccttcaaagacgatggcgctcacggacctggctacctctatgaaggagtctggcattgatgtgatcggcctggctgccggcgagcccgacttcgacacgcccgccgccatcgtggaggcgggtgtggcggcgctgcggcagggctacacgcgctacacgcccaacaccggcacctcggcgctcaggaaggcgatttgcaagaagctcaagggtagggcgggcggggtgggtgtgcgtgggagtgtgtgggtggcttatgaaaagggcaaggcgtgtggcaagagtgggagagctgctacagacatctgcactcgggggggggcggggggcttgttggcaccctcgcatgagacgtacgaagcgctgtccacaagggcaggggcaagggcgctaaggttgcccactcgggttcccgtgtcgcacgcactcacgcactcaccggagctcgaccgcgctccaccccacacgcccacacgcccacgcagccgcctgctcatcctgtgcacgccctccaaccccaccggcgccgtctaccccaaggagcacctggaggcgctagccgccgtgatcgccaagcaccctcggctgctggtgctgagcgacgagatctacgagtacatcacctacgcccccgccacccacgtcagcttcggagcgctgcccggcatgttcgagcgcacactcaccgtcaacggcttctccaaggcctacgccatgacgggctggcgcctgggctacctggcggcgcccaagcactacgccaaggccgccgccatcatccagtcgcagtccaccagcggcgcctcctccatcagccagcaggcggcgctggcggcgctggcgctggggcccggcggcggcgagccggtgcaggccatggtgcgcgccttccgcgagcgaagggactacgtgtcggcgcggctcaaggccatccccggcgtgaacctggctgagcccgccggcgccttctacgtgctgcccgagatgagcgccttcttcgggccgggcgccgcggcacagggcttcggggccgtgcccgacagcgacaccttctgccgctacctgatcgaggtggccaacgtggcggtggtgcctggcgacgccttcggcgcggacagctgcatccgcatctcctacgccgccagcctggagacgctgggcaaggcgctggaccgcatcgccgccgccctggacccggcggtgtacaccttgcgcaccgacaggcagtga

SEQ ID NO: 150 - protein, 434 aa, Chlamydomonas reinhardtii
MSAAAAPAGAVKVDTTLNPLVASVKPSKTMALTDLATSMKESGIDVIGLAAGEPDFDTPAAIVEAGVAALRQGYTRYTPNTGTSALRKAICKKLKGRAGGVGVRGSVWVAYEKGKACGKSGRAATDICTRGGAGGLLAPSHETYEALSTRAGARALRLPTRVPVSHALTHSPELDRAPPHTPTRPRSRLLILCTPSNPTGAVYPKEHLEALAAVIAKHPRLLVLSDEIYEYITYAPATHVSFGALPGMFERTLTVNGFSKAYAMTGWRLGYLAAPKHYAKAAAIIQSQSTSGASSISQQAALAALALGPGGGEPVQAMVRAFRERRDYVSARLKAIPGVNLAEPAGAFYVLPEMSAFFGPGAAAQGFGAVPDSDTFCRYLIEVANVAVVPGDAFGADSCIRISYAASLETLGKALDRIAAALDPAVYTLRTDRQ

SEQ ID NO: 151 - DNA, 1582 bp, Gossypium hirsutum
tctcttcaatcttcggacaaatggcagtttctcttcataactcaacaggaatttccggtgttggcttcgactcaaaatttttgggatcacattctgcttccaaggcctccgtttccgtgtctttccattcctctattactaatctttccttaaaatctgttgagacttctaaacaacagtcatatagaataactgcaatgtcaaagacagagagtagcagcgaccaagtgaaacttgatatctctttgagccctagagttaactctgtgaagccttcaaagacagtggctataactgatcatgcaactgctcttgcacaagctggtgtccctgtcattcgattggctgctggagagcctgattttgatacaccagccatcatagctgagactgggataaatgctattcgtgaaggttacacaaggtacactcccaatgcaggtactttggaacttcgtacggcaatttgtcataagctaaaagaggagaatggaatctcttattcgcatgatcaaattgtggtcagtaatggtgctaaacagagtatccctcaagcagttcttgcagtttgttctcctggggatgaggtaataattcctgctccatattgggtgaagtacccggaaatggcaaggctggctgacgcaacacctactattcttccgacactcatctgtgacaattttctattggatccagaggtccttgagtctaaaatctctgcaaagtcaagactgttgatcctatgctctccatcaaatccaactggatctgtttaccctaagaagctgcttgaaaaaattgcagaaattgtagcaaagcatcccaggcttctggtgctgtctgatgaaatatatgagcatataatctatgcaccggcaactcacacaagctttgcatcattgccaggcatgtgggagcggactctaacagtcaatggcttttccaaggcttttgcgatgactggttggcgacttggatacattgctggacctaaacactttgtcgcagcatgtaataagatccagagtcagtccacttcaggagctagtagtatagcacaaaaagcaggagttgccgcattaggcttgggctgtgctggtggggaagcaatttccaccatggtggaagcattcagggaacggcgagatttcttggttaagagctttggggaattggaaggtgttaagatatcagaacctcagggagctttccatctattcattgatttcagctcctactacggaatagaagctgaaggttttggcaaaatcgaaaattcggagtcactttgtcgatacttcctggacaaggctcaggttgcactagtccctggagatgcatttggggatgatagctgcattcggatatcatatgcagcatccctcaccaccttacaagctgcttttgagagaattaagaaagcactcatctccctcaggcctgctgttcctgtttaacacatgaattatatatcatttagcatgtttaattgttggttgtattttgttttgggatttgaattttttatgttttaataagctttttttttaataaactctggattttctctgttctcttc

SEQ ID NO: 152 - protein, 479 aa, Gossypium hirsutum
MAVSLHNSTGISGVGFDSKFLGSHSASKASVSVSFHSSITNLSLKSVETSKQQSYRITAMSKTESSSDQVKLDISLSPRVNSVKPSKTVAITDHATALAQAGVPVIRLAAGEPDFDTPAIIAETGINAIREGYTRYTPNAGTLELRTAICHKLKEENGISYSHDQIVVSNGAKQSIPQAVLAVCSPGDEVIIPAPYWVKYPEMARLADATPTILPTLICDNFLLDPEVLESKISAKSRLLILCSPSNPTGSVYPKKLLEKIAEIVAKHPRLLVLSDEIYEHIIYAPATHTSFASLPGMWERTLTVNGFSKAFAMTGWRLGYIAGPKHFVAACNKIQSQSTSGASSIAQKAGVAALGLGCAGGEAISTMVEAFRERRDFLVKSFGELEGVKISEPQGAFHLFIDFSSYYGIEAEGFGKIENSESLCRYFLDKAQVALVPGDAFGDDSCIRISYAASLTTLQAAFERIKKALISLRPAVPV

SEQ ID NO: 153 - DNA, 1692 bp, Glycine max
gggttcagttttcatatggccaacacactatataacggcgccacatgccgaatccctctccggaaccaatccctggccttctctcgccacgtttgcagatccctctctttcctccctatgtgagttctctcctctcttcttccctgcaatttcacttcacacaccaattgctctctctcacccttcgcagaacacgtgcggcaaaacaacccaacgcaattgcggttaaggcttcttcgcactctgacttcgacgttgacctttcgctcagtcctcgtgtcaatgccgtcaagccttccaaaaccgtcgccatcagcgaccacgccaccgctctcgtccaagccggcgttcccgtcatccgcctcgccgccggcgagcccgatttcgacacgcccgctcccatagccgaggctgggattaatgcaattcgtgaaggttacacgaggtacacgcccaatgccggaaccatggaactgcgccaagcgatttgtcacaagctaaaagaagagaatgggattacttatactcctgaccaagttgtggttagtaacggagccaaacagagtattgctcaggcagtgcttgcagtttcctcccctggagatgaggttattattccagctccattctgggttagttacccagaaatggcaaggttggctgatgcaacacctgtgattcttccaaccttaatatctgataatttccttttggatcccaaactcctcgaatccaaaattactgaaagatcaagactgcttattctttgttctccatctaacccaacgggatctgtctaccccaaagaattacttgaagagatagcccgaattgttgcaaagcaccccaggcttctggttctctctgatgaaatttacgaacacataatttatgcaccagcaactcacacaagctttgcatctttaccaggaatgtgggacagaactcttactgtgaatggattttctaaggcctttgcaatgactggttggcggcttggatatattgctggtccaaaacattttgttgcagcatgtggaaagatccaaagtcagttcacttcaggggccagtagtatagctcagaaagctgcagttgctgcattaggactaggccatgctggtggggaggcagtttctaccatggtgaaagcatttagggagcgaagggatttcttggtacaaagttttagagaaatagatggtgtcaagatatctgaaccccagggagcattttatctattccttgatttcagcttctattatggaagagaagctgaaggattcggtaaaattgaggattctgagtccctctgtcgatatctactggatgtgggccaggtagccctggtgccagggagtgcatttggagatgacacttgcatccgcatctcttatgcagaatcccttactaccctacaggcagctgtagaaagagttaagagagcacttatcccgctgagctctgctgcacttgtttaatattgctgttttgttgtaatgggtgtattttatttttattttaattttggcaatgtgtaatctgtttattctgaaaatattaggctttggatattcttccataaaatgaagtgatacaactgtctttaatggtttaaaaaaaaaaaaaaaaaaaactcgaggttttttttttttttttttttttttttttttttttttttttttttgggga

SEQ ID NO: 154 - protein, 478 aa, Glycine max
MPNPSPEPIPGLLSPRLQIPLFPPYVSSLLSSSLQFHFTHQLLSLTLRRTRAAKQPNAIAVKASSHSDFDVDLSLSPRVNAVKPSKTVAISDHATALVQAGVPVIRLAAGEPDFDTPAPIAEAGINAIREGYTRYTPNAGTMELRQAICHKLKEENGITYTPDQVVVSNGAKQSIAQAVLAVSSPGDEVIIPAPFWVSYPEMARLADATPVILPTLISDNFLLDPKLLESKITERSRLLILCSPSNPTGSVYPKELLEEIARIVAKHPRLLVLSDEIYEHIIYAPATHTSFASLPGMWDRTLTVNGFSKAFAMTGWRLGYIAGPKHFVAACGKIQSQFTSGASSIAQKAAVAALGLGHAGGEAVSTMVKAFRERRDFLVQSFREIDGVKISEPQGAFYLFLDFSFYYGREAEGFGKIEDSESLCRYLLDVGQVALVPGSAFGDDTCIRISYAESLTTLQAAVERVKRALIPLSSAALV

SEQ ID NO: 155 - DNA, 1632 bp, Hordeum vulgare
ctccaatggccttctcacccgtctccaccccttcctcctcctcctcctccccgtccttcaccctccccaccaaaccctccacgggcacaggctccgtctccttctccagggcgtcgcgggagaggcggcagccctcgaggaagtccaggatggcggcggtgagggcggaggcggtggacacgtccatcagcccgcgggtcagcgcgctgcggccgtccaagaccatggccatcaccgaccaggccagcgcgctgcggcaggccggggtgcccgtcattggactcgccgctggggagcccgacttcgacacgccggcggcgatcgccgaggctgggatgaatgcaatcagggatggctttacaaggtacacacctaatgccgggactatggagctgaggaaagccatctgcaacaagcttcaggaggagaatggtctaacatacagcccagatcaggtgctagtgagcaatggagctaagcagtgcattacacaagctgttcttgctgtttgctcacctggtgatgaggttttgataccagcgccattctgggtcagctatcctgaaatggctaggttggctggtgcaacaccagtgatcctcccgacaagcatatcagacagtttcctgctaaagccagaatcgcttgcctctgtgatcactgaaaaatcaaggctcttgattctatgctctccatctaatccaacgggctctgtgtatcctagggagctgcttgaggagattgctgctatagtcaagaagtatcctaggctcctggttctttctgatgagatctatgagcatattatctatcatcctgctaagcacacaagctttgccgcattacctggaatgtatgacagaacactaactgtaaatgggttttctaaggcttttgctatgactggttggcgacttgggtatttagctgcccctaaacattttgtctcagcctgtggaaagatccaaagccagtacacatctggtgccagtagtatatcgcagaaggcagggcttgcagccttgaacctaggttatgccggcggtgaagcagtttcgaccatggtcaaagcattccaggagcgccgggactaccttgtaagaagtttcagggaactgccaggagtcaaaatatcagaacctcagggtgccttttatttgttcatcgacttcagctcctactatggatccgaggtagagggttttggcactatcaaggactctgagaccctctgcatgttcctgctagagaaagcacaggttgcgcttgtccctggggatgcatttggagatgacacgggtgttcgtatctcatatgccgctgcactatcaacactacaatctgcaatggagaagataaaagacgcaatgactctgctcaaggcccctgccgcggttcaatgaaaacagcgtgctgaaggcattttcaccagcaatgctgcaccgtcatattaaaagcatgtccatcgggagaatatgaaaacatgccattgttgtgcaacagttagttcaccttttttgtttggttgcaaacttgcgaaggatttgttttgttccaatcttttcatttggtgtaatgtaattgtctttacctgcaagtcagaaatgaaaataatatgttgttttgacagcc

SEQ ID NO: 156 - protein, 465 aa, Hordeum vulgare
MAFSPVSTPSSSSSSPSFTLPTKPSTGTGSVSFSRASRERRQPSRKSRMAAVRAEAVDTSISPRVSALRPSKTMAITDQASALRQAGVPVIGLAAGEPDFDTPAAIAEAGMNAIRDGFTRYTPNAGTMELRKAICNKLQEENGLTYSPDQVLVSNGAKQCITQAVLAVCSPGDEVLIPAPFWVSYPEMARLAGATPVILPTSISDSFLLKPESLASVITEKSRLLILCSPSNPTGSVYPRELLEEIAAIVKKYPRLLVLSDEIYEHIIYHPAKHTSFAALPGMYDRTLTVNGFSKAFAMTGWRLGYLAAPKHFVSACGKIQSQYTSGASSISQKAGLAALNLGYAGGEAVSTMVKAFQERRDYLVRSFRELPGVKISEPQGAFYLFIDFSSYYGSEVEGFGTIKDSETLCMFLLEKAQVALVPGDAFGDDTGVRISYAAALSTLQSAMEKIKDAMTLLKAPAAVQ

SEQ ID NO: 157 - DNA, 1814 bp, Malus domestica
cacgagccaacccaattggaggagcaatccaactccaacaccactacctgctccacccacccccatggccgccttttccctccagacatcgacctccagcattgcccttcccagtttcgaaatccgaatccccggatccgatttgggttcaaacccaaaatccatatgtttcacttgtcagcctcgtttgcttcctctcacgcgtcggagcaacagtaagagtagatcaagaggaggagttgtgatggcggtggcagtgactggcaatgaccagtcccaagtggaagtcgacgtctctctgagcccacgagtcaactccgtcaagccttcgaagacagtcgccattactgaccaggccacggctctcgtgcaagccggagtgcccgtcattcgattagctgctggcgaacctgatttcgataccccttccatcgtagctgaggcgggtatcaatgcgattcgcgaaggcttcaccaggtacacaccaaatgcagggactttggagctgcgccaagcaatttgtcataagctcaaagaggagaatgggatcacttacacaccggatcagatcgtagttagcaatggagccaagcagagcattgttcaagctgtgcttgcagtttgttccccaggggatgaggttatgattccagctccattttgggtgagttaccctgaaatggcaaggatggccgatgcaactcctgtgattcttccaacgagcatctccaatgattttctcttagatcctaaacttctcgaatccaaactcactgagaagtcaagactgctgattctttgttctccatccaaccccacagggtctgtctaccccaagaatttgcttcaagagattgctaagattgtagcaaagcatcccaggcttctggttatttctgatgaaatatatgaacacataatttacgcaccggcaactcacacaagctttgcatccttgccaggcatgtgggagaggactctgacaatcaatgggttttccaaggcttttgcaatgactggttggcgacttggatatattgccgggcctaaacactttgttacggcatgtggaaagctccagagtcagttcacctcaggtgccagtagtatatcacagaaagcaggagttgctgccttaggtctcggttatgctggtggagaggcagttactactatggttaaagcgttcagggagcgacgggatttcttggtcaaaagctttggcaaactttcaggtgtcaggatttcagaacccaggggagctttctatctcttcatagatttcagcgcttactatggaacggaggctgaaggatttggtaaaattgagaattcagagtccttatgccgttacctacttgacaagggccaggttgcactagtaccaggagatgcgtttggagatgatacgtgcatacgaatctcctatgcagcatcccttcccaccctacaggcagctgtggagagaattaagaaagcacttgttgaactaaagccctcagttggtgtttaacgaaaactaaaatgtttccggtattgccactgttctacttgttgtaactctgtattctagtatctgtttcgaagttatgcataagttggtcacgtcggggacgtctaaaataattctttcggagttgtatttgatagtaatgtaaacacaggcgtgtttgtttcgttgaatcggatttcaagaattcgaaactcattttttgactgggtttttcttactggaaaaactaatgaaatccgacattttcagcggaatatctggaaatattggaaataaaatggccacggtttgagaaaaaaaa

SEQ ID NO: 158 - protein, 482 aa, Malus domestica
MAAFSLQTSTSSIALPSFEIRIPGSDLGSNPKSICFTCQPRLLPLTRRSNSKSRSRGGVVMAVAVTGNDQSQVEVDVSLSPRVNSVKPSKTVAITDQATALVQAGVPVIRLAAGEPDFDTPSIVAEAGINAIREGFTRYTPNAGTLELRQAICHKLKEENGITYTPDQIVVSNGAKQSIVQAVLAVCSPGDEVMIPAPFWVSYPEMARMADATPVILPTSISNDFLLDPKLLESKLTEKSRLLILCSPSNPTGSVYPKNLLQEIAKIVAKHPRLLVISDEIYEHIIYAPATHTSFASLPGMWERTLTINGFSKAFAMTGWRLGYIAGPKHFVTACGKLQSQFTSGASSISQKAGVAALGLGYAGGEAVTTMVKAFRERRDFLVKSFGKLSGVRISEPRGAFYLFIDFSAYYGTEAEGFGKIENSESLCRYLLDKGQVALVPGDAFGDDTCIRISYAASLPTLQAAVERIKKALVELKPSVGV

SEQ ID NO: 159 - DNA, 1632 bp, Nicotiana tabacum
ccgcatcttcgtcaagaattgcttcaagaccctccattcctcctggacttcattctgattcattcaatcccgcttcaatctctttctcttctaaccttcacagcctttctctcaaatcttcaggctcaaagagacagctatactcacctagaacaggtgcagttgtcataacacagagcatggacagagttgaggttgatatctcgctcagccctagggtaaattcagtaaagccttcaaaaacagttgctataaccgaccaggcaactgctcttgcgcaagctggtgtacctgttattcgattagcagctggtgaacctgattttgacactccagttcctatagcagaggctgggataaatgcaattcgcgaaggtcataccaggtatacaccaaatgcaggtactatggaacttcgttcagcgatttgtcataagttaaaagaggagaatgggctatcatacacgcctgatcagattttggtaagcaatggggcaaaacaaagtattgtacaggcagtgcttgcagtttgttccccaggagatgaggttcttattccagctcccttttgggtgagttaccctgaaatggcaaggatggcagatgcaacgcctgtgattcttccaaccagcatatctgaagattttctcttacatccaaagcttcttgaatctaaacttagcgagaagtcaagacttctgattctttgttctccatccaacccaacagggtctgtttaccctcggaaattgcttgaagagattgctgagattgttgctaggcatccgaggcttcttgtgatatcagatgaaatttacgaacacattatttatgcaccagcaactcataccagctttgcatctttgcctggtatgtgggatcggactctcaccgtaaatggtttctctaaggcatttgcgatgactggttggagacttggttatatagctggtcctaaacactttgtttctgcatgcaataagatccagagccagttcacatcaggtgccagtagcatctcccaaaaagcagctgtggctgctctgggactgggctatgctggtggagaagcagttgcaactatggtaaaagcattccgtaagcggcgagattaccttgtcaagagctttggggaaatagatggtgtcaaaatttcagagcctcggggggctttctatctatttattgatttaagctcttattatggagcagaggttgatggatttggctccatcaacaactcagaatctctttgccgatatttgctggataaagctcaagtagcgcttgtcccgggggatgcattcggggatgacacatgtatccgtatctcctatgcagcatcgctctcaaccttgcaggcagctgtggagagaatcaacaaagcattggttactcttaaacctactgtcccagtttagaacatgcatcaattactgcatgctaatttgaatgcaccaacagacaaaaggttgtatactagtttgtagtctgtccttccctgttctgttttcatgtattcttaagtgcattactggcgattatttctcctggatctttgagaaagttcctatactctgaagttgttgatttgtgtgcaaattcttggttgatgattaaaaatgcaaataa

SEQ ID NO: 160 - protein, 413 aa, Nicotiana tabacum
MDRVEVDISLSPRVNSVKPSKTVAITDQATALAQAGVPVIRLAAGEPDFDTPVPIAEAGINAIREGHTRYTPNAGTMELRSAICHKLKEENGLSYTPDQILVSNGAKQSIVQAVLAVCSPGDEVLIPAPFWVSYPEMARMADATPVILPTSISEDFLLHPKLLESKLSEKSRLLILCSPSNPTGSVYPRKLLEEIAEIVARHPRLLVISDEIYEHIIYAPATHTSFASLPGMWDRTLTVNGFSKAFAMTGWRLGYIAGPKHFVSACNKIQSQFTSGASSISQKAAVAALGLGYAGGEAVATMVKAFRKRRDYLVKSFGEIDGVKISEPRGAFYLFIDLSSYYGAEVDGFGSINNSESLCRYLLDKAQVALVPGDAFGDDTCIRISYAASLSTLQAAVERINKALVTLKPTVPV

SEQ ID NO: 161 - DNA, 1647 bp, Ocimum basilicum
attaagattttatcaagatggcggctgctccctcttatttcattcaccccacatcaacaactgggagccaccttcacccaaaatctcaggcagatgtttcgctgaattctaaatcactctctttctcctcccaattccacaccttctccttcaaatcattacgtgcaacaggacaactgtatccggagggagttagtgcaatggtgaaagcggagatgaagtcagagacgacgcaggttgatatcagtctgagccccagagtaaactcagtgaagccatcaaagacggtggctatcacagaccaggcaactgcacttgctcaagcaggtgttcctgttattcggctagcagctggagaacctgattttgatactccagctccaattgctgaggctggtattaatgcaattcgtgaagggttcactcggtatactcccaatgcgggcacattggaactccgtactgctatttgtcacaagctaaaagaggagaatggattatcctacacacctgaccagattttggtgagtaatggtgcgaaacagagtattgttcaggcagttcttgcagtgtgttctcctggagacgaggtgattattccatctccattttgggtgagctacccagaaatggcaaggttggctgatgctacccctgtaattcttccaacgagcatatctgaaaactttcttttagatccaaaggttcttgaatccacactgagtgagaagtcgaggctgttgattctttgctctccttccaacccaacagggtctgtttacccccgtaaattgctcgaacagattgctgaaattgtagccaagcatcccaggcttctggttctgtccgatgaaatttatgagcatatcatttatgctccagcaactcatacaagctttgcatctttgccaggcatgtgggatagaaccttgactgtcaacggcttctcaaaggccttcgccatgactggttggagactagggtatcttgctggtccaaagcactttgttgctgcatgtgggaagatccaaagtcagactacttcgggtgcgagcagcatatctcaaaaagctgcggttgctgctttaggaatgggatatgcaggcggcgaagcagttgcagttatggttaaagcattccgtgagaggagagatttcctggtcaagagctttggagaattagacggtgtcaaaatctcagagcctcagggagctttttatcttttcctggatttcagttcttactatggatcaaaggttgatggattcggtgtgatcaatgactcagagtccctgtgccggtatttgcttgataaggctcaagttgccctggttccaggagatgcatttggagacgacacgtgcattcgcatatcatatgctgagtcgctgaccacactacaggcggccgtagacagaatcaaggaagctttacttgccctcaaggcagcacccatccctgtctagttgttgaatttgttccaagtttttaactctacacctctctcgtttctgttttctaccaatttctatttgcatttagagtagtcaatactaggttgttgaattttgaatgctcaaattcttgttcttctagtgtaatttgtcaaaatttccattgttaaatataattttcaagttactcgag

SEQ ID NO: 162 - protein, 482 aa, Ocimum basilicum
MAAAPSYFIHPTSTTGSHLHPKSQADVSLNSKSLSFSSQFHTFSFKSLRATGQLYPEGVSAMVKAEMKSETTQVDISLSPRVNSVKPSKTVAITDQATALAQAGVPVIRLAAGEPDFDTPAPIAEAGINAIREGFTRYTPNAGTLELRTAICHKLKEENGLSYTPDQILVSNGAKQSIVQAVLAVCSPGDEVIIPSPFWVSYPEMARLADATPVILPTSISENFLLDPKVLESTLSEKSRLLILCSPSNPTGSVYPRKLLEQIAEIVAKHPRLLVLSDEIYEHIIYAPATHTSFASLPGMWDRTLTVNGFSKAFAMTGWRLGYLAGPKHFVAACGKIQSQTTSGASSISQKAAVAALGMGYAGGEAVAVMVKAFRERRDFLVKSFGELDGVKISEPQGAFYLFLDFSSYYGSKVDGFGVINDSESLCRYLLDKAQVALVPGDAFGDDTCIRISYAESLTTLQAAVDRIKEALLALKAAPIPV

SEQ ID NO: 163 - DNA, 1638 bp, Oryza sativa
acaacaacacaaactacctaccgctgcgacacacgcagccgagctaagcgctaccaccctcccatccatggcggcctccacctccgccacctccttctccactcccaccaagcccgcctcctcctcctcctcctcctcaagtcccaactccgtctgcttcgccagggcgtcggggaggtgcaggatggcgtcggtggtggtgagggcggaggcggtggacgcgaccatcagcccgacggtgagcgcgctgcggccgtccaagaccatggccatcaccgaccaggccacggcgctgcggcaggctggcgtcccggtcatcggcctcgccgccggggagcccgacttcgacacgccgcacgtgattgctgaggctgggatgaatgcaattaaggatggttatacaaggtacactcctaatgctgggactttggagctgagaaaggctatctgcaataaactccaagaggaaaatgggatatcctacagtccagatcaggtgctggtgagcaatggagctaagcaatgcattacgcaagccgtacttgccgtttgctcacctggtgatgaggttttgataccagcaccatactgggtcagttatcctgagatggctacattggctggtgcaactccagtgatccttcctacaagcatatcagagaatttcttgctaaggccagagctgcttgcttcaaagatcaacgagaaatcgaggcttttgattctctgctctccttctaatccaactggatcagtatatccaaaggagctgcttgaagaaatagctgacatagtcaagaagtatcctaggcttcttgttttgtctgatgagatttatgagcatatcatctatcagccagcaaaacacacaagctttgcttcattgcctggaatgtgggatagaacattaactgtaaatggtttttctaaggcttttgcaatgacgggctggcgacttggataccttgcagccccaaaacattttgttgcagcctgtggaaagatccaaagccagtttacttcaggtgctagtagcatatcacagaaggcagggctcgctgctttgaaccttggctacgctggtggtgaagcagtctcaactatggtcaaagcattccaggaacgtcgtgattaccttgtaaaaagtttcaaggaactgccaggtgtgaagatatcagagcctcagggtgccttttatttgttcatcgacttcagctcctactatggatctgaagtagagggttttggcactatcaaggactctgagtccctctgcatgttcctcttggagaaagcacaggttgcacttgtcccgggcgatgcatttggggacgacaaatgcatccgcatgtcatatgctgcagcactatctacgcttcaaactgctatggagaaaatcaaagaagctgttgcgctgatcaaaccccgtgttgctgctaagtgaaaatgtgaggttatacaatggcagtggggagtgaccaaaggcgccttcaactgccacttcggtaccatttgaaatacaaacgatgtgtcattgtctgacaagtaagaatttttgttgtttgattgtgtctgctgtgataaagaacttgaatgtaactccgggaaaatggataatacttcttgatttctttttct

SEQ ID NO: 164 - protein, 458 aa, Oryza sativa
MAASTSATSFSTPTKPASSSSSSSSPNSVCFARASGRCRMASVVVRAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVSNGAKQCITQAVLAVCSPGDEVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGWRLGYLAAPKHFVAACGKIQSQFTSGASSISQKAGLAALNLGYAGGEAVSTMVKAFQERRDYLVKSFKELPGVKISEPQGAFYLFIDFSSYYGSEVEGFGTIKDSESLCMFLLEKAQVALVPGDAFGDDKCIRMSYAAALSTLQTAMEKIKEAVALIKPRVAAK

SEQ ID NO: 165 - DNA, 1284 bp, Physcomitrella patens
atgactgtgtgtgcaactagtaacggtgtgaatggaggttcaactccagtcgatactaccataagcccccgggtagcagccttaaaaccatcgaagactatggccattgcagatgcagccactgctctggtggagtccggtgttcctgttataagactggcagccggggagccagacttcgacaccccgaaggcaatagtagaggccggaacaaaagcaattcaagagggcttcactaggtacactccaaatgcaggcactctagagttacgaaaagctatttgtcacaaattgcaagaggaaaatgggttgtcctacaaacctgatgagattctagttagtaatggcgccaagcaaagcattatgcaagctgtactcgccgtatgttcccctggtgatgaggttattgtgccagctcctttctgggtcagctaccctgagatggcacgtttggcagacgcaacgcccgtcattgttcaaactaaggtgtcggaaaatttcatattgaagccagaagcactgtctgctgtattgactgagaaatccagagttttgatcttatgttctccatcaaatccgacaggctcagtatatacccttgaagatctgcaggcaattgctgcaattgttgcaaaacatccgcgtttgctggtgatctctgatgaaatctacgagcacatcatgtacactccagcaacgcatcatagctttgcagcattgccgggaatgtgggaacgtactcttacagttaatggtttctctaagtgttttgcgatgactggttggcgattgggatatttagcagctccgaaacactttttggtggcttgcaacagaattcagagtcagtcaacttctggagcaagcagcatttctcaaaaggctggagtagcagcattggccctgggcaaagcaggaggcgaagatgtagtgacaatggtgaaagctttcagagagcgaagggactttctggtacaacgtctgcaagctatggatggtgttgtacttgccgttcctcagggagccttctacttgtttccagatttcagtgcttactttgggagtcacgctgatggatttgggtttatttctgatgctgaaactctatgccgtttctttctagaaaaagccaaggtagctctagtcccaggagacgcttttggcaacggtggatgcatccgaatatcatatgcagcgtccatggaagaactgaaaacggccattgagagtattgagtctgttatggctctgcttaaacctgcatcagctgcctcccttgcttag

SEQ ID NO: 166 - protein, 427 aa, Physcomitrella patens
MTVCATSNGVNGGSTPVDTTISPRVAALKPSKTMAIADAATALVESGVPVIRLAAGEPDFDTPKAIVEAGTKAIQEGFTRYTPNAGTLELRKAICHKLQEENGLSYKPDEILVSNGAKQSIMQAVLAVCSPGDEVIVPAPFWVSYPEMARLADATPVIVQTKVSENFILKPEALSAVLTEKSRVLILCSPSNPTGSVYTLEDLQAIAAIVAKHPRLLVISDEIYEHIMYTPATHHSFAALPGMWERTLTVNGFSKCFAMTGWRLGYLAAPKHFLVACNRIQSQSTSGASSISQKAGVAALALGKAGGEDVVTMVKAFRERRDFLVQRLQAMDGVVLAVPQGAFYLFPDFSAYFGSHADGFGFISDAETLCRFFLEKAKVALVPGDAFGNGGCIRISYAASMEELKTAIESIESVMALLKPASAASLA

SEQ ID NO: 167 - DNA, 1976 bp, Pinus pinaster
acatgtttggctctccatccgtggcatatacagtgcctcaattaaaattggcaccgcactgaaattctgagaatatttggttacggaaggaaagaggtcaccagaagagggatttagttacatttggcacactaactacgaaatgatgtctgcaagctttaagtgcccagtatcattgtcaggtgtggaaaatatatgtaacggggacaaggctattcccgggatcaactcgaggactttgttcacagggagttcattcttacaacgacatcatagtgccaacaagatctttttcaggacgtgtggaaaaaaggggagctgttgcttgttcaacataagagccatggctgagacggacagtggaaatggtgtaccacaacttgatatctcactgagtccaagggtggcagcccttaaaccatcaaagacaatggccataacagaccttgcaactgcacttaagcaagctggagttcctgttatcggattagcagctggtgaacctgattttaatacaccagatgcagtagctgaggcaggcattaaggcaattcaggatggctatactcgatatacacctaatgcaggaactatggagattagaactgctatttgtcataagttaaaagaggaaaatggcctctcatatacacctgaccagatattggttagtaacggagcaaaacaatgcatcatggcagcagctgttttagcagtttgttcaccgggtgatgaggttattattccagctccattttgggtaagctatactgaaatggctcggttagcagatgcaactccagtgataattccaactttattatcagatgattttctattgaatccagaagtattttcttcaaagctgaatgaaaattcaaggttattgattctttgttcaccttccaacccaactggatctgtttatccaagagaattgctagaagaaatagcaaaaattgttgcaaagcatcctaagttactggttctgtcagatgaaatctacgaacacattatgtatccaccagcaaagcacacgagctttgcttctttgccaggaatgtgggaaagaacactgactgttaatggattctctaaggcctttgcaatgacaggttggcgacttgggtacttggcaggaccaaagcactttgttacagcttgtggaagaattcagagccagtccacatcaggtgctagcagtatctctcagaaagcaggggttgctgctttggccttgggatatgctggtagtgaagcagtgtctactatggtcaaagcatacagggagaggagagacttcttagtccaaagattgcaagccatggagggtgttaaattaccagtgcctcagggtgctttttatttatttcccgattttagttcctactatggaactgaagtggaagattttggtgttatcaatggctcagaagctctctgtcgtttcttcctagagaaggcacaagttgctcttgtcccaggagatgccttcggcaatgatgactgcattcgtatttcatatgctgcatcccttgacacgcttagaacagccataaacaatatagagaagtccttgttgcttctgcgccctgctgctgcagcatctaaggcaagctaactactgagtaatatttagtgattctgaagagcaataatgtttcacatggaattatattctcaccatatatcttgaaatggcctgaaaggtggccagactatataaagaacactggaaaaaatgttcaagtttaggtagaactttagaagttgagttgaatgtgtcaaccatctctaggtgttgaaaatttgctattgctgttatatgtgttcattttaccaatgttcgtagtaaaagtcagtttcttgtttccagtcaggacttgggattgctgagctcctgtttgaggtgatcgtgtaggcaaatctatttatgtcacttttattgtaagataaaaattgttgattgctatgac

SEQ ID NO: 168 - protein, 492 aa, Pinus pinaster
MMSASFKCPVSLSGVENICNGDKAIPGINSRTLFTGSSFLQRHHSANKIFFRTCGKKGSCCLFNIRAMAETDSGNGVPQLDISLSPRVAALKPSKTMAITDLATALKQAGVPVIGLAAGEPDFNTPDAVAEAGIKAIQDGYTRYTPNAGTMEIRTAICHKLKEENGLSYTPDQILVSNGAKQCIMAAAVLAVCSPGDEVIIPAPFWVSYTEMARLADATPVIIPTLLSDDFLLNPEVFSSKLNENSRLLILCSPSNPTGSVYPRELLEEIAKIVAKHPKLLVLSDEIYEHIMYPPAKHTSFASLPGMWERTLTVNGFSKAFAMTGWRLGYLAGPKHFVTACGRIQSQSTSGASSISQKAGVAALALGYAGSEAVSTMVKAYRERRDFLVQRLQAMEGVKLPVPQGAFYLFPDFSSYYGTEVEDFGVINGSEALCRFFLEKAQVALVPGDAFGNDDCIRISYAASLDTLRTAINNIEKSLLLLRPAAAASKAS

SEQ ID NO: 169 - DNA, 1553 bp, Populus trichocarpa
gccaactaaaacgccaaccttccgtcacccatggctgcttcaacttcaagcatttcccgtcttggttttagacaccaccaacctctcggaaccaatccgggttcccactctcaaccctccggatctgtctctttcctttctgggtctcactgtttctacttcaaaccattggaggctactagacaatcacagttgtctagagtaagtgtagtggtgaaggcagaaagtaggtctgaggagatgcaagtcgatatttctttgagtccaagggtgactgctgtaaaaccttcaaagactgtggccataactgaccaggcgactgcgcttgcacaagctggagtccctgttattcgcctggctgctggagagcctgattttgatactccagctgtaatagcagaggctggtataaatgctattcgtgaaggtcacacaaggtacactccaaatgctggtacacaggagcttcgagttgcaatttgtcagaagttgaaggaggagaatggtatatcttataaacctgaccaaattttagtaagcaatggggccaagcagagtatatatcaagcgatacttgcagtttgctctcctggcgatgaggttataattccagcaccattttgggtgagttatccagaaatggcaaggctggctgatgcaaccccggtgattcttccaacatcaatctctgagaattttctcttggacccaaagcaacttgaatcaaaactgaatgaaaagtcaaggctgctgattctttgctctccatctaacccaacaggatcagtttatcctaagaaattgcttgaagagattgcaaaaattgtagcaaaacatcctaggcttctggtcttgtctgatgagatatatgaacacataatatatgcacctgctactcacacaagctttgcatctttgcccggcatgtgggaaaggactttgacagtgaatggattttctaaggcctttgcaatgactggttggagacttgggtaccttgccggccctaagcactttgttgctgcatgtaataagatacagagccagtttacctcaggtgccagcagcatatcgcaaaaggcaggagttgcagcattaggactaggctatgctggtggggaagcagtgtccaccatggtgacagcattcagggagcggagagatttcttgattaaaagctttggagaaatggaaggtgttgggttgtcggaacctctgggagcattttatcttttcattgatttcagctcgtactatggagcagaggttgaagggtttggtaaaattgacgactctgacgccctttgccgttacctgcttgatcaggcccaggttgcattagttccaggggttgcatttggagatgacagctgcatacgtatatcctatgcagcttctctgaccaccctacaggcagctgtagagagaattaagaaagcgcttctcccactcaagtctgccgtccctgtgtaatgtagatgaattgcaattgttgtactcttttagagattaaaaaaaggggcacttcattattgattgttacaaataaaatg

SEQ ID NO: 170 - protein, 480 aa, Populus trichocarpa
MAASTSSISRLGFRHHQPLGTNPGSHSQPSGSVSFLSGSHCFYFKPLEATRQSQLSRVSVVVKAESRSEEMQVDISLSPRVTAVKPSKTVAITDQATALAQAGVPVIRLAAGEPDFDTPAVIAEAGINAIREGHTRYTPNAGTQELRVAICQKLKEENGISYKPDQILVSNGAKQSIYQAILAVCSPGDEVIIPAPFWVSYPEMARLADATPVILPTSISENFLLDPKQLESKLNEKSRLLILCSPSNPTGSVYPKKLLEEIAKIVAKHPRLLVLSDEIYEHIIYAPATHTSFASLPGMWERTLTVNGFSKAFAMTGWRLGYLAGPKHFVAACNKIQSQFTSGASSISQKAGVAALGLGYAGGEAVSTMVTAFRERRDFLIKSFGEMEGVGLSEPLGAFYLFIDFSSYYGAEVEGFGKIDDSDALCRYLLDQAQVALVPGVAFGDDSCIRISYAASLTTLQAAVERIKKALLPLKSAVPV

SEQ ID NO: 171 - DNA, 1586 bp, Populus trichocarpa
actactaaacgcctccttgaatattcactcatggcagctacttcaacttcaaccagttatcgtcttggtttccgactccaccaacaactcgcaccctgttcaggttctcaccctcaaacctccggagccgtgtcctttctttcagggtctcacaatttctccttcaaatcgttggagactactagacgatcacagttgtctagaataagtgtagttgtgaaggcagaaagtaggtctgaagagatgcaactcgatatttctttgagtccaagggtgaatgctgtaaaaccttcaaagacagtggccataacggaccaggctactgcgcttgtacaagctggggttcctgttattcgtttggctgctggagagcctgattttgatacaccggttgtaatagcagaggctggaataaatgcaattcgcgaaggtttcacaaggtatactccaaatgctggtacacaggagcttcgagttgcaatttgtcataagctgaaggaggagaacggtatctcttatacacctgaccaaattttagttagcaatggtgccaagcagagtatatatcaagcaatgcttgcagtttgctctcctggcgatgaggttattattcctgcaccattttgggtgagttacccagaaatggcgaggctggctgatgcaaccccagtgattcttccaacatcaatctctgaaaactttctcttggatccaaagctacttgaatcaaaactgagtgcaaagtcaaggctgttgattctttgttctccatctaacccaacaggatcagtttattccaagaaattgcttgaagagattgcacggattgtagcgaaacatcctaggcttttggtcttgtctgatgagatatacgaacacataatatatgcacctgctactcacataagctttgcatctttgcccggcatgtgggaaaggactttgacagtgaacggattttctaagattaacatttggaaagcgggaaatttgcaggcctttgcaatgactggttggagactggggtatattgctggtcccaagcactttgttgcagcgtgtaataagatacagagtcagtttacatcaggtgccagcagtatatctcaaaaggcaggcgttgctgcactaggactcggctatgctggtggggaagcagtttctaccatggtgaaagcattcatggagcggagagatttcttgattagaagctttggagaaatggaaggtgttaggatgtcagaacctcagggagcattttatcttttcattgataccagctcgtactatggaacagaggctgaaggttttggtaaaatcgaggactctgactccctttgccgttacctgttggatcaagcccaggttgctctagtcccaggggttgcatttggagatgacagctgcatacgtatctcatatgcagcatctctgaccaccttacaggaggctgtagggagaattaagaaggctctactcccactcaagtctgctgtccctgtttaatgtgaagaatgttaaattgcaattgtactctttcagggtttaaaaatgtgtactactttattgattgttacaaataaaac

SEQ ID NO: 172 - protein, 491 aa, Populus trichocarpa
MAATSTSTSYRLGFRLHQQLAPCSGSHPQTSGAVSFLSGSHNFSFKSLETTRRSQLSRISVVVKAESRSEEMQLDISLSPRVNAVKPSKTVAITDQATALVQAGVPVIRLAAGEPDFDTPVVIAEAGINAIREGFTRYTPNAGTQELRVAICHKLKEENGISYTPDQILVSNGAKQSIYQAMLAVCSPGDEVIIPAPFWVSYPEMARLADATPVILPTSISENFLLDPKLLESKLSAKSRLLILCSPSNPTGSVYSKKLLEEIARIVAKHPRLLVLSDEIYEHIIYAPATHISFASLPGMWERTLTVNGFSKINIWKAGNLQAFAMTGWRLGYIAGPKHFVAACNKIQSQFTSGASSISQKAGVAALGLGYAGGEAVSTMVKAFMERRDFLIRSFGEMEGVRMSEPQGAFYLFIDTSSYYGTEAEGFGKIEDSDSLCRYLLDQAQVALVPGVAFGDDSCIRISYAASLTTLQEAVGRIKKALLPLKSAVPV

SEQ ID NO: 173 - DNA, 1847 bp, Solanum lycopersicum
gatagaatgaaagaaaaaagacaactacttcaccaaccaaagaggaaagcagcctccaacaacaattaggcttctttcttctaatcttaccaaccctcttctgtttcactcactatatataaaaacatatttattccatcgcccaaatgaagtttcatcgtccacttgaaaacccaactttgaaattgcttatagaacccaccaaatgactgctgcttcatcttcttctctattgggttcatcaagaattggttcaggacctaccatttctggacttcattcagattcactcaaccccacatcaatctccttctcttctaacctacaaggtctctctctaagatcttcaggggcaaagagacagctatactcacgtggaacaggttcagttgtcatagcacagaacatggacagagttgaggttgatctctctctcagccccagggtaaattcagtaaagccttcaaaaacggttgctataactgatcaggcaactgccctcgtgcaagctggtgtacctgttattagattagcagctggtgaacctgattttgatactccagccccaatagcagaggctggcataaatgcaattcgtgaaggtcataccaggtatacaccaaatgcaggtacaatggaacttcggtcggctatttgtcataaattaaaagaggagaatgggttatcatacactcctgatcagattgtggtaagcaatggggcaaaacaaagtattgttcaggcagtgcttgcagtttgttctccaggggatgaggttcttattccagctccctattgggtgagttaccctgaaatggcaaggatggcagatgcaatgcctgtgattcttccgaccagcatatccgaagattttctattagatccaaagcttcttgaatctaaactgactgaaaagtcaagacttctgattctttgttctccatccaacccaacagggtctgtttaccctcggaaattgcttgaggagattgctgagattgtggctaggcatccgaggcttcttgtgatatcagatgaaatttacgaacacattatttatgcaccagcaactcataccagctttgcatctttgcctggtatgtgggataggactctcactgtaaatggtttctctaaggcctttgcgatgactggttggagacttggctatattgctggtcctaaacactttgtttctgcatgtaataagttacagagccagttcacgtcaggtgcaagtagcatctcacaaaaagcagctgtggctgctttgggactgggctatgctggtggagaagcagttgcaactatggtaaaagcatttcgtgagcggcgagatttccttgtcaagagctttggggaaattgatggtgtcaaaatttcagagcctcggggagcattttatctatttattgatttaagctcttattacggagtagaggttgatggatttggcaccatcaacaactcagaatctctttgccgatatttgctggataaatctcaagttgcgcttgtccccggggatgcatttggggatgacacatgtatccgtatctcctatgcagcatcgctttcgaccttgcaggcagctgtggagagaatcaagaaagcattggttactctcagacctcctgtcccagtgtaaaacatgaattactaatatttgcttatttgggatgtgctacagccaaacatgcataaataatatgtagtctgacccaaccctccatgttctctcattttatgtattcttaagtgcattcctgtacactgacattgttaatttgtgtgcaatttctcagttgatgattgaaaatcaaaataatcgagtgatatttatctct

SEQ ID NO: 174 - protein, 480 aa, Solanum lycopersicum
MTAASSSSLLGSSRIGSGPTISGLHSDSLNPTSISFSSNLQGLSLRSSGAKRQLYSRGTGSVVIAQNMDRVEVDLSLSPRVNSVKPSKTVAITDQATALVQAGVPVIRLAAGEPDFDTPAPIAEAGINAIREGHTRYTPNAGTMELRSAICHKLKEENGLSYTPDQIVVSNGAKQSIVQAVLAVCSPGDEVLIPAPYWVSYPEMARMADAMPVILPTSISEDFLLDPKLLESKLTEKSRLLILCSPSNPTGSVYPRKLLEEIAEIVARHPRLLVISDEIYEHIIYAPATHTSFASLPGMWDRTLTVNGFSKAFAMTGWRLGYIAGPKHFVSACNKLQSQFTSGASSISQKAAVAALGLGYAGGEAVATMVKAFRERRDFLVKSFGEIDGVKISEPRGAFYLFIDLSSYYGVEVDGFGTINNSESLCRYLLDKSQVALVPGDAFGDDTCIRISYAASLSTLQAAVERIKKALVTLRPPVPV

SEQ ID NO: 175 - DNA, 1723 bp, Solanum lycopersicum
gatcttaccaaccctcttccatttctctatataaaaaaatatttattccatcgcccaaatgaagttccatcgtccacttgaaaacccaactttgaaattgcttatagaacccaccaaatgactgctgcttcatcttcttctctactgggttcatcaagaattggttcaagacccaccatttctggacttcattcagattcactcaaccccagatcaatcaccttctcttcaaccctccaaggtctctctctcagatcttcagggtcaaagagacagctatactcacgtggaacaggttcagttgtcatagcacagaacatggacagagttgaggttgatctctctctcagccccagggtaaattcagtaaagccttcaaaaacggttgctataactgatcaggcaactgccctcgtgcaagctggtgtacctgttattagattagcagctggtgaacctgattttgatactccagccccaattgcagaggctggcataaatgcaattcgtgaaggtcataccaggtatacaccaaatgcaggtacaatggaacttcgatcggctatttgtcataaattaaaagaggagaacgggctatcatacactcctgatcagattgtggtaagcaatggggcaaaacaaagtattgttcaggcagtgcttgcagtttgttctccaggggatgaggttcttattccggccccctattgggtgagttaccctgaaatggcaaggatggcagatgcaacgcctgtgattcttccgaccagcatatctgaagattttctattagatccaaagcttcttgaatctaaactgactgaaaagtcaagacttctgattctttgttctccatccaacccaacagggtctgtttaccctcggaaattgcttgaggagattgctgagattgtggctaggcatccgaggcttcttgtgatatcagatgaaatttacgaacacattatttatgcaccagcaactcataccagctttgcatctttgcctggtatgtgggataggactctcactgtaaatggtttctctaaggcctttgcaatgactggttggagacttggctatattgctggtcctaaacactttatttctgcatgtaataagttacagagccagttcacatcaggtgcaagtagcatctcccaaaaagcagctgtggctgctttgggactgggctatgctggtggagaagcagttgcaactatgttaaaagcatttcatgagcggcgagatttccttgtcaagagctttggggaaattgatggtgtcaaaatttcagtgcctcggggagcattttatttatttattgatttaagctcttattacggagtagaggttgatggatttggcaccgtcaacaactcagaatctctttgccgatatttgctggataaatctcaagttgcgcttgtccctggggatgcatttggggatgacacatgtatccgtatctcctatgcagcatcgctttcgaccttgcaggcagctgtagagagaatcaagaaagcattggttactctgaaacctcctgtcccagtgtaatacattacacgcatcagtaatgtttgtagtctgacttgaccctccatgttctctcattatatgtattcttaagtgcattcctgtattctgaagttgttgatttgtgtgcaatttcttggtggatgattgaaaataaaaataattgagtgtgacatttatctcc

SEQ ID NO: 176 - protein, 480 aa, Solanum lycopersicum
MTAASSSSLLGSSRIGSRPTISGLHSDSLNPRSITFSSTLQGLSLRSSGSKRQLYSRGTGSVVIAQNMDRVEVDLSLSPRVNSVKPSKTVAITDQATALVQAGVPVIRLAAGEPDFDTPAPIAEAGINAIREGHTRYTPNAGTMELRSAICHKLKEENGLSYTPDQIVVSNGAKQSIVQAVLAVCSPGDEVLIPAPYWVSYPEMARMADATPVILPTSISEDFLLDPKLLESKLTEKSRLLILCSPSNPTGSVYPRKLLEEIAEIVARHPRLLVISDEIYEHIIYAPATHTSFASLPGMWDRTLTVNGFSKAFAMTGWRLGYIAGPKHFISACNKLQSQFTSGASSISQKAAVAALGLGYAGGEAVATMLKAFHERRDFLVKSFGEIDGVKISVPRGAFYLFIDLSSYYGVEVDGFGTVNNSESLCRYLLDKSQVALVPGDAFGDDTCIRISYAASLSTLQAAVERIKKALVTLKPPVPV

SEQ ID NO: 177 - DNA, 1813 bp, Triticum aestivum
agcttcaatggcgttctcctccctctccaccccttcctcctcctccccctcctcgtctttcaccctccccaccaagccctccccgggcgcaggctccctctccttctccaaggcgtccacggggaggttcaggatggcggcggtgagggcggaggcggtggacacgtccatcagcccgcgggtgagcgcgctgcggccgtccaagaccatggccatcaccgacatggccagcgcgctgcggcaggccggggtgcccgtcattggactcgccgctggggagcccgacttcgacacgccggcggtgatcgccgaggctgggataaatgcaatcagggatgggtctacaaggtacacacctaatgcagggactatggagctgaggaaagctatctgcaacaagcttcaagaggagaatggtctaacctacagcccagatcaggtgctagtgagcaatggagctaagcagtgcattacacaagctgttcttgctgtttgctcacctggtgatgaggttttgataccagcaccattttgggtcagctatcctgaaatggctaggttggctggtgcaacaccagtgatcctcccgacaagcatatcagacaatttcctgctgaagccagagtcacttgcctcagtgatcactgagaaatcaaggctcttgattctatgctctccatctaatccaacaggctctgtgtatcccaaggagctgcttgaggagattgctgctatagtcaagaagtatcctaggctcctggttctatctgatgagatctatgagcatattatctatcatcctgctaaacacacaagctttgctgcattacctggaatgtatgacaggacattaactgtaaatgggttttctaaggcttttgctatgactggctggcgacttggatacttagctgcccctaaacattttgtctcagcttgtggaaagatccaaagccagtacacatctggtgccagtagtatatcgcagaaggcagggcttgcagccttgaaccttggttatgccggcggtgaagcagtttcaaccatggtcaaagcattccaggagcgccgggattaccttgtaagaagtttcagggaactgccaggagtaaaaatatcagaacctcagggtgctttctatttgttcctcgacttcagctcctactacggatccgaggtagagggttttggcactatcaaggactctgagaccctctgcatgttcctgctagagaaagcacaggtcgcgcttgtccccggagatgcatttggtgatgacaagggtgttcgtatctcctacgctgccgcactgtcaacgctacaatctgccatggagaagataaaagacgcaatgtctctgctcaaggcccctgctgcggttcaataaaaatagcgtgctgaaggcattttcaccggaattacattaaaagcatgtccattgggaaaataggaagcatgccattgttgtacaacagatagttcaccatttttctggttgcaaacttgcgagcaatttgctttgtttcaaacttctcacttggtgtaatgtaattgtctttacctgcaggccagaaatgaaaataatatgttgctttgacaacctaagacgggaaataattgatgttcactgatttggaaaaaaaaaaaaaaaaaaaaaaaaaaaggggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgg

SEQ ID NO: 178 - protein, 459 aa, Triticum aestivum
MAFSSLSTPSSSSPSSSFTLPTKPSPGAGSLSFSKASTGRFRMAAVRAEAVDTSISPRVSALRPSKTMAITDMASALRQAGVPVIGLAAGEPDFDTPAVIAEAGINAIRDGSTRYTPNAGTMELRKAICNKLQEENGLTYSPDQVLVSNGAKQCITQAVLAVCSPGDEVLIPAPFWVSYPEMARLAGATPVILPTSISDNFLLKPESLASVITEKSRLLILCSPSNPTGSVYPKELLEEIAAIVKKYPRLLVLSDEIYEHIIYHPAKHTSFAALPGMYDRTLTVNGFSKAFAMTGWRLGYLAAPKHFVSACGKIQSQYTSGASSISQKAGLAALNLGYAGGEAVSTMVKAFQERRDYLVRSFRELPGVKISEPQGAFYLFLDFSSYYGSEVEGFGTIKDSETLCMFLLEKAQVALVPGDAFGDDKGVRISYAAALSTLQSAMEKIKDAMSLLKAPAAVQ

SEQ ID NO: 179 - DNA, 2216 bp, Volvox carteri
ggaatcgtgctgcggtctcgtgctgcgcccgtacggagtaggaagggaaacagccgagaaaagctacctgcttacagcgcgcttgctggaccacacgcacaaaatcagatgaactgccgggctcactgatttgggtacctcgctatcccattagccgcctccgcatccttcaggatcggcagcagaaattggcagagacatgtttgttatgcacaattctaccgcacatagtagatcacacaacggatcaatcgcgtgcggaggtcgcacttgcatcgaacgccttgcgagggcgacgactccgcattgcccgattaccagcagcgttatcacagctacccgtgctaaaacaataagcatggccgcagcggcagcagcgcctacgtctaatgttgtcccggtcgacacgacgctcaatccccttgttgcgtcggtcaagccgtcaaagacaatggcgctgacagaccttgccacttcaatgaaggaagccggcatcgatgtcatcggccttgcagccggcgagcccgactttgacacccccgcgcccatcgtggaagcgggtgtggctgctctgcgggcgggctacacccggtacacccccaatacgggaaccaccgctctgaggaaggcaatttgcaagaagctccaggatgacaacggtctgagctacagtccggatgaggttgtggttagcaatggcgccaagcagtccatctggcaggcggtactggctaccgtgtcacccggagacgaggtcattatcccggcgccgtactgggtgtcgtacactgagatggtacggctggcgaatgcgacgcccgtggtggtgcctacgacccccgaggagggctttctgatgagccctgagaagttggcagcgaccctgactccccgtagtcgcttgctcatcttgtgcagcccctccaaccccacgggggctgtctaccccaaggagcacctggaggctttggcgcgcgtggtgggcgcccatcctaggctgctcgtactgtcggacgagatttacgaatacatcacgtatgcaccagccaaacatgtgtcctttggcgcgctgcctggcatgtgggaccgcaccctcacggtcaacggcttctccaaggcctacgctatgaccggctggcgtcttggctatctggctgcgccgcgcatttacgccaaggctgccgccatcatccaatcccagtccacttcaggcgcctcatctatcagccagcaggccgccttggcagccctggcgctggggccgggcggcggagagccggtgcagcagatggtcagggcatttcaagagcgacgggattttgtgtgcgctcggctgcgcggcatccctggagtcaacctggctgagcccagcggcgccttctacgtgctacccgaaatgagcgccttcttcggtcccggcgcacatgcggacggctttgggcccgtacccgactcggacaccttttgtcgctacctcatcgaaaaggccaacgtcgctgtcgtgcccggggacgcctttggcgctgacagctgcatccgcatttcctacgccgcgtccttggagacgctgggcaaggcgctggaccggattgcagcctccctggaccccaaaatctataaacgccgtacgggctctagctaagattctggatcctggatctgcctgtatcatttactcgacaactatggacgtagcttaatctggcgttgataggagttgtgattgttcaaactggtgagcgagtcgctccgaaagaggaagggacagttagttgctaggatgagcttcacagccgttcccgagcagggcttgctgtgaaggtactcctcgggacaggggacggctgggaagctctggtctgggcttaaagctgtgcgcaggtggtggaaacagggttaggtgctttggaggggcgtttctcgacgggactggatttcgcaacgccagacaatgacatgcgcgccgtcccatttcgaacccccccggctggtggcgccatgccgaaatataggttgtgttattatgcgctgcttttttggggctccgttgcttaccttactaccatgtttatgcgagcttaggtaaatgtggttggggttgtatgtggcagggacaagggtggctgaccgtaaatgacacgatgtgctttgcccggcgtgagctcctccgtcgagttgtgaatgtaactctgcttctgtaatacgtgcattccgtt

SEQ ID NO: 180 - protein, 480 aa, Volvox carteri
MFVMHNSTAHSRSHNGSIACGGRTCIERLARATTPHCPITSSVITATRAKTISMAAAAAAPTSNVVPVDTTLNPLVASVKPSKTMALTDLATSMKEAGIDVIGLAAGEPDFDTPAPIVEAGVAALRAGYTRYTPNTGTTALRKAICKKLQDDNGLSYSPDEVVVSNGAKQSIWQAVLATVSPGDEVIIPAPYWVSYTEMVRLANATPVVVPTTPEEGFLMSPEKLAATLTPRSRLLILCSPSNPTGAVYPKEHLEALARVVGAHPRLLVLSDEIYEYITYAPAKHVSFGALPGMWDRTLTVNGFSKAYAMTGWRLGYLAAPRIYAKAAAIIQSQSTSGASSISQQAALAALALGPGGGEPVQQMVRAFQERRDFVCARLRGIPGVNLAEPSGAFYVLPEMSAFFGPGAHADGFGPVPDSDTFCRYLIEKANVAVVPGDAFGADSCIRISYAASLETLGKALDRIAASLDPKIYKRRTGSS

SEQ ID NO: 181 - DNA, 1233 bp, Vitis vinifera
atggaggttgatatctcactgagtcccagagtaaattctgtaaagccttctaaaacagtagctattactgaccaagcaactgctcttgtacaagctggagtccctgttatacgattagcagctggagaacctgattttgatactccagctgtgatagctgaggctgggataaatgcaattcgtgaaggttacacaaggtacactccaaatgcgggtactttggaagtccgttcagcaatttgtcataagttgaaggaggaaaatgggctctcatatacacctgatgagattttggttagtaatggagccaaacagtctattcttcaagcagtgcttgcagtttgctccccaggagatgaggttataattccagctccattctgggtgagttacccagaaatggcaagactggcagatgcaacacctgtcattcttccaacacttatctctgaaaattttctcctagatccaaagtttcttgagtccaaactcactgaaaagtcaagattgctgattctatgttctccatccaacccaaccggatcagtttactccaggaaactgcttgaagagattgctcagattgtagcaaggcaccccaggcttctggttttgtctgatgaaatatatgaacatattatttatgcaccagcaactcatacaagctttgcagctttgccaggcatgtgggagaggactttgacagtcaatgggttttctaaggccttcgcaatgactggctggcggcttgggtatcttgctggtcctaaacactttgttgctgcatgtggaaagattcagagtcagttcacttcaggtgccagtagcatatctcagaaagcagcagttgctgcattgggaatgggctatgctggtggggaagctgtttccacaatggtaaaagcattcagggaacggcgagatttcttggttaaaagctttggagaactggagggtgtcaagatatcagagccccagggagctttttacctctttcttgacttcagctcttactatggggcagaggctgaaggttttggtataattgagaattcagagtccctctgccgatatctgctggaccaggcccaggttgcccttgtcccaggggatgcatttggagacgacaagtgcattcgcatatcctatgctgcatccctctccaccctacatgcagccgtggagagaattaagaaagcagttgttcctctttggcctcctgtccctgtctaa

SEQ ID NO: 182 - protein, 410 aa, Vitis vinifera
MEVDISLSPRVNSVKPSKTVAITDQATALVQAGVPVIRLAAGEPDFDTPAVIAEAGINAIREGYTRYTPNAGTLEVRSAICHKLKEENGLSYTPDEILVSNGAKQSILQAVLAVCSPGDEVIIPAPFWVSYPEMARLADATPVILPTLISENFLLDPKFLESKLTEKSRLLILCSPSNPTGSVYSRKLLEEIAQIVARHPRLLVLSDEIYEHIIYAPATHTSFAALPGMWERTLTVNGFSKAFAMTGWRLGYLAGPKHFVAACGKIQSQFTSGASSISQKAAVAALGMGYAGGEAVSTMVKAFRERRDFLVKSFGELEGVKISEPQGAFYLFLDFSSYYGAEAEGFGIIENSESLCRYLLDQAQVALVPGDAFGDDKCIRISYAASLSTLHAAVERIKKAVVPLWPPVPV

SEQ ID NO: 183 - DNA, 1634 bp, Zea mays
gacgattgtacactactcgtcagatgacaactcaaacaacgtcagtcccactgctgctaaagctgagcccccagacccccagcagctagcagccgcctcctcgtcaggcccttcctccttcaccctcgccaaacccgcctcctccggtccgaactccgtctgcttcatctgagcgtccgggaggacaaaacacgcggcgaggaccaggatggcgattgtgcgggaggaggcagtggacacgtccatcagcccaagggtgagcgcgctgcggccgtccaaaaccatggccatcaccgatcaggccatggcgctgcggcaggccggcgtgccggttatcggtctagccgcgggggagccagacttcgacacgccgcccgcgatcgcggaggccgggatggatgcaattaggaatggttatacaagatacactcctaatgctgggactttggagctgaggaaggctatttgtactaaactccaggaggagaacggggtatcctacctcccagatgaggtgctggtgagcaatggagctaagcaatgcatcacacaagctgtgcttgcagtttgctcacctggtgatgaggttttgattccagccccatattgggtcagttatcctgagatggctagactggctgatgcgactccagtgattcttcctacaaacatatcagagaatttcttgttaaggccagagttgcttaccgacaagatcaatgagaaatcgaggctcttaattctctgctctccatctaatccaacagggtcagtatatccaaaggagttgcttgacaaaatagctgatatagtcaagaagcatccgaggcttttggttttatctgatgaaatttatgagcatattatctatcagcctgcaaaacacacaagctttgcttcactacctggaatgtgggaaagaacattaactgtaaatggtttttctaaggcttttgcaatgacgggttggcgtcttggttaccttgcagcccctaaacattttgttgcagcatgtggaaagatccaaagccagttcacctcaggtgccaacagcatatcacagaaggcagggcttgcagctctgaatcttggctatgctggtggtgaagcagtatcaactatggtcaaagcattccaggaacgccgtgactatcttgtgaaaaatttcaaggaactgcctggtgtgaaaatatcagaacctcagggtgccttttatttgttcattgacttcagcgcctactatgggtctgaagtagaggggtttggcactatcaagaattccgagtccctttgcatcttcctattagagaaagcacaggttgcccttgtccctggtgacgcatttggggatgacaagtgcattcgtatttcatatgctgcatccctaactacacttcagactgcgatgtcaaaattaaaggaagctgttgctctgctcaagccctgtgttgctgcgtagcaagatcactaaattgcaataaggagtgaccaaggcacctttaactaacctttcacgttattttaaacacaatgttcgaattgtttgggcagacttggtccgttgtttttatatgtaacattatggatttatgatgtgtacatgcaaataaaaatggtttgtttaaaaaaaaaaa

SEQ ID NO: 184 - protein, 416 aa, Zea mays
MAIVREEAVDTSISPRVSALRPSKTMAITDQAMALRQAGVPVIGLAAGEPDFDTPPAIAEAGMDAIRNGYTRYTPNAGTLELRKAICTKLQEENGVSYLPDEVLVSNGAKQCITQAVLAVCSPGDEVLIPAPYWVSYPEMARLADATPVILPTNISENFLLRPELLTDKINEKSRLLILCSPSNPTGSVYPKELLDKIADIVKKHPRLLVLSDEIYEHIIYQPAKHTSFASLPGMWERTLTVNGFSKAFAMTGWRLGYLAAPKHFVAACGKIQSQFTSGANSISQKAGLAALNLGYAGGEAVSTMVKAFQERRDYLVKNFKELPGVKISEPQGAFYLFIDFSAYYGSEVEGFGTIKNSESLCIFLLEKAQVALVPGDAFGDDKCIRISYAASLTTLQTAMSKLKEAVALLKPCVAA

SEQ ID NO: 185 - DNA, 1757 bp, Zea mays
tgcgtgtcgggcttaccaagcggagcagtataacgcaggggcttggtccagcgacttctcagaaacgcgccaccagccaacgagcaagggccgcagccggagctccaatggcctccttctcctccctctctgcctcctcctccacctccaccccgtccttcaacctccccgcaaaaacctccgctggcacaggctccctgtcattccacagggcgagggagtcgcagaagtccagggccaggatggtgacggtgcgggcggaggcggttgacacgaccatcagcccgcgggtgaatgcgctcaggccgtccaagaccatggccatcaccgaccaggccacggcgctgcgacaggccggcgtgccagtcatcggactcgccgctggggagcccgacttcgacacgccagccgtgatcgccgaggctgggataaatgccatcagagatggggccacaagatacacgcctaatgctggaactctggagctgaggaaggctatctgcaaaaagcttgaggaggagaatggtctatcatactccgccgatcaggtgctagtaagcaatggagccaagcagtgcattacacaagcagtactcgctgtctgctcacctggcgatgaagttttgatacctgcaccatattgggtcagctaccctgagatggctagactggctggtgcaacgccagttattctccctacaagcatatcagacaattacctgctaaggccagagtcacttgcctcagtgatcaatgaaaattcaaggatcttgattctctgctctccatctaatccaacagggtctgtgtatcctaaggagttgcttgaggagattgctgctatagtcagaaagcaccctagactcctagttttatccgatgagatctatgagcatattatctatcaacctgctaaacacacaagctttgcttcattgcctggaatgtgggaaagaacgttaactgtgaatggattttctaaggcttttgctatgactggttggagacttggatacttagctgcccctaaacattttgtcgcggcctgtggaaagatccaaagccagtatacctctggagccagtagtatatcacagaaggcagggcttgcagctttgaacctaggttatgctggtggtgaagcagtatcaaccatggtgaaagcattccaggagcgtcgtgattaccttgtaagaagctttagggagctgccaggtgtcaagatatcggaacctcagggagccttctatttattcatcgacttcagctcgtactatgggtctgaggtggaaggttttggtaccatcaaggactctgagtccctctgtctgttcctgttggagaaggcacaggttgcgcttgtccctggggatgcatttggcgatgacaagggtgttcgcatttcatatgctgcagctatgtcgacactgcaaactgcaatgggaaagataaaagaagcgatggctctgctcaggccccctgttgccgtttaacaaaaccaacgtatcgctaatcagttgtggaccaaaggcttctgcaatgcactatcatattaaatacattcagttgacatgatctatcttcttccctttatggaaaaaaatgttgctgctgtcatttggctttggtttgtatctgaagatttatatgtacttgctataatatagatgaactgtgcaacgctttttttacctgcaagaatagaaatggtaaacatgactttattttgacaatttgagtcgtgaatgtttcatatt

SEQ ID NO: 186 - protein, 461 aa, Zea mays
MASFSSLSASSSTSTPSFNLPAKTSAGTGSLSFHRARESQKSRARMVTVRAEAVDTTISPRVNALRPSKTMAITDQATALRQAGVPVIGLAAGEPDFDTPAVIAEAGINAIRDGATRYTPNAGTLELRKAICKKLEEENGLSYSADQVLVSNGAKQCITQAVLAVCSPGDEVLIPAPYWVSYPEMARLAGATPVILPTSISDNYLLRPESLASVINENSRILILCSPSNPTGSVYPKELLEEIAAIVRKHPRLLVLSDEIYEHIIYQPAKHTSFASLPGMWERTLTVNGFSKAFAMTGWRLGYLAAPKHFVAACGKIQSQYTSGASSISQKAGLAALNLGYAGGEAVSTMVKAFQERRDYLVRSFRELPGVKISEPQGAFYLFIDFSSYYGSEVEGFGTIKDSESLCLFLLEKAQVALVPGDAFGDDKGVRISYAAAMSTLQTAMGKIKEAMALLRPPVAV

SEQ ID NO: 187 - DNA, 1266 bp, Aureococcus anophagefferens
atggccgcaccggcccgccggtccgccgcgcgcagcttgtccgcgtggagcaacgtgcagagcgcgcccgccgatcctatcttgggcttgacgcaggacttcctcgcggacacggacgccaagaaggtctccctgggcgtcggcgcgtaccgcgacgagaacggcaagccctacgtgctgccgtccatcgccgaggcggagaagcgcgtcgtcgcgtcgctgacggaccacgagtacgcgccgatcaccggcgacgccaagttcctcgcgtcgagcctcgagttcgcctacggcgcgggctcggcgccgctcgcggagaagcgcgtcgcggccacccaggccctcagcggcacgggctgcctccgcgtcgccgcgcagctcctcgagcgcctgccgtcgctcaccggcggcgacgcgagcaagaagcaggccatctacgtgccggacccgacgtggagcaaccacctgaacatcttccgcgacgcgggcctcgagatccgcacgtaccgctacctcgacgcggcgacgcgcacgaagctcgacttcgacgcgatgctcgaggacctgtcggccgccgagtccggcgcgacgatcctgctccacgcctgcgcgcacaacccgacgggcgtcgacccgtccatggaccagtggaaggccctgtcggcggccctcaaggccacgggcgcgcagctcttcttcgactgcgcgtaccagggcttcgcgtccggcgacgcggagcgcgacgcgggcggcctccgccacttcgtcgccgagggccacacgctcatgctcgcccagtcctacgcgaagaatttcgggctctacggcgagcgcgtcggcgcgctgtccatggtctgcgcggacgccgcggaggcgcgcgcgctcgagtcgcagctcaaggccgtcatccgccccatgtactcgagcccgccggtgcacggcgcgcgcgtcgtcgccgaggtcctcggcgatgcccaactccgcgccaagtggacggccgagtgcaaggccatggccgaccgcatctccgagatgcgcgcggcgctcaaggccaagctcgcggacgcggggtccacgcgcgactgggcccacatcacggaccagatcggcatgttcgcctacacggggctcacggccgaccaggtccaggccatgcgcgacgagttccacgtctactgcacgctcgacggccgcatctccgtcgcggggctcacgccgtcgaacgtcgaccacgtcgccaaggcgatccacgccgtctccaagtag

SEQ ID NO: 188 - protein, 442 aa, Aureococcus anophagefferens
MQTVLAVLCLVPAAALVRGAPSRVAATPRKASPSAYLSEIPQGPPDAILGIAAAFRASNADDKVNVCVGAYRDDVGVPYVLPSVTEAERRLLDRGEKKEYAPIEGLADFRQKALEFAYGEDCAALKEGRIAGVQTLSGTGACRVAGEFYARFLPEGTAVYVSDPTWGNHIPIMELAGLEVRKYRYLDRETNGLDYEAFLEDIDAAPAGSVFLLHACAHNPTGVDPTRDQWDAVSKKILAKGHHVLMDCAYQGFASGDAEADAFAIRKFLDDGHSLLLAQSFAKNFGLYGERVGTLSVVCKDTEEVERVMSQLKRIIRPMYSSPPIHGALIVKEVLSDDALRAQYYDECAQMAERIGGMRVRLREEIEAAGSEHDWTHVTDQIGMFAFTGMTSDMCDTLTADYSIYLTKDGRISVAGVNSGNIKYIAKAVHEVTHGKEIGVAA

SEQ ID NO: 189 - DNA, 1329 bp, Aureococcus anophagefferens
atgcagaccgtgctcgctgtgctctgcctcgtccccgcggccgcgctggtgcgcggcgccccgagccgcgtcgctgccacgccgcgcaaagcgtcgccgagcgcctacctgagcgagatcccccagggtccgccggacgccatcctcggcatcgccgcggccttccgcgcgtccaacgccgacgacaaggtgaacgtctgcgtcggcgcgtaccgcgacgacgtcggcgtgccctacgtgctgccgtcggtcaccgaggcggagcgtcggctgctcgaccgcggcgagaagaaggagtacgcgcccatcgagggcctcgcggacttccgccagaaggcgctggagttcgcctacggcgaggactgcgcggcgctcaaggagggccgcatcgccggcgtgcagacgctgtcgggcacgggcgcgtgccgcgtcgcgggcgagttctacgcgcggttcctgcccgagggcacggccgtctacgtctcggacccgacctggggcaaccacatccccatcatggagctcgcgggcctcgaggtgcgcaagtaccgctacctcgaccgcgagacgaacggcctggactacgaggcgttcctcgaggacatcgacgccgcgccggcgggaagcgtcttcctgctccacgcctgcgcgcacaacccgacgggcgtcgacccgacgcgggaccagtgggacgccgtgtcgaagaagatcctcgccaagggccaccacgttctcatggactgcgcgtaccagggcttcgcgtccggcgacgcggaggcggacgcgttcgcgatccgcaagttcctcgacgacggccactcgctcctgctggcccagtccttcgcgaagaactttggcctctacggcgagcgcgtcggcacgctctccgtcgtctgtaaagatacggaggaggtcgagcgcgtcatgtcgcagctgaagcgcatcatccggcccatgtactccagcccgcccatccacggcgccctcatcgtcaaggaggtgctcagcgacgacgcgttgcgcgcccagtactacgacgagtgcgcgcagatggccgagcgcatcggcggcatgcgcgtccgcctccgcgaggagatcgaggccgcgggctccgagcacgactggacccacgtcacggaccagatcggcatgttcgccttcacgggcatgacctccgacatgtgcgacacgctcacggccgactactccatctacctcacgaaggacggccgcatctccgtcgcgggcgtcaactccggcaacatcaagtacatcgccaaggccgtccacgaggtcacccacggcaaggagatcggcgtcgccgcgtaa

SEQ ID NO: 190 - protein, 416 aa, Aureococcus anophagefferens
MKLAYFASLATAQECISRWGDVAVPPADPVLGIKAQFVADDTPTKIGLSVGAYRDDDGNPWVLPPVEAARERLFGPNGTTTHEYLSIDGFERYNKLAQGLLYGPEEANHDVVTVQALSGTGALRLAMEFLNRHYPGPRTAYIPAVTWSNHWNIFKDAGWADSRPYTYLDKAGLRLEWSSLLADLEAAPEGSVVLLHLCAHNPSGVDPSRDQWKELAALVKRKGLFPLFDSAYLGFATGDLDADAWPFRYFLQQGLAPWACVSFSKNFGLYSERTGAVHATVASPHEADAVRGHLKKVARAMYSNPPAFGARVVAAVLDDPDLKAAWLDTLKVMSSRIGDMRTALRAKLDSLDTGRDWSHITSQIGMFSYTGMTKSEVLKIREKHHVYMLESGRISMAGINTKNVDQLATAIADVLE

SEQ ID NO: 191 - DNA, 1296 bp, Aureococcus anophagefferens
atgctagtcgcgccgcgccgcgccgccggcagcgcgcgggctttgggcctcttcgccggcgtcgaggccgtgccccaggacccgatcctcggcctcgtcgccgagttcaaggccgacgccttcccggccaaggtgaacctcgcccagggcgcctaccgcaccgagggcggcgagccgctgctcctcgaggccgtcagggaggcggagcggcgcgtcgtcgcccggggcgcgtcgaaggagtacctgcccgtcgagggcctccggagctttgtcgacgcggccgcggcgttcgcgctcggcgccgactcgccggcgctcctcgacgggcgcgtcgcgtcgctccaggcgctgtcgggcacgggctcgctgcgcgtctgcgcggagatgctccgggacgtcgccggcgtcgccgaggtgcacctgccgcggccgtcctgggcgaaccacgccgcgatcttcgccaaggccgggctcgccgtcggggactacgcgtacctcgacgcgacgcggacgtccctcgactttgaagccatggtcgcggacctcgaacggctcccgcccgactccgtcgtcctcatgcacgccgcggcccacaacccgagcggcgtcgacccgacgcgcgaccagtggcgggcgctcgcggacctcttcgcggagaaaaaactcgtccccctcttcgacacggcctaccagggcttcgcgtcgggcgacgaggaggccgacgccttcgccgtgcgactcttcgaggcccggggccacgcgcccatcctctgccagtccttcgcgaagaacctgggcctctacggcgagcgcgtcggcgcggtccacgtcgtctgcgactccgaggccgaggcggcgaacctgctgtcgcgcgtcaagcagctcgtcgtgcgacccatgtactcgagcccgccactccacggagcgagcctcgccgcggaggtgctcggcgacggcgagctccgggagcggtggcgcggcgagctcctcgcgatggcgcagcgcatcgtcgacgtccgcgccgcgttgcggggcgagctcgagcgcctcgacgcggcgccgccgggcgcccacggctggcggcacatcacggaccagatcggcatgttcgccttcacgggcctcaccgcgccgcaggtccggtccatgcgcgcggtggagcacgtctactgcacggagaacggccgcatgagcctcgcgggcctcgccgccgcggacgtgccctacgtcgccgccgccgtcaagcgcgccacggacgcgatcccctacgaggcgcgcgtcgccgtcgccgcgtga

SEQ ID NO: 192 - protein, 421 aa, Aureococcus anophagefferens
MAAPARRSAARSLSAWSNVQSAPADPILGLTQDFLADTDAKKVSLGVGAYRDENGKPYVLPSIAEAEKRVVASLTDHEYAPITGDAKFLASSLEFAYGAGSAPLAEKRVAATQALSGTGCLRVAAQLLERLPSLTGGDASKKQAIYVPDPTWSNHLNIFRDAGLEIRTYRYLDAATRTKLDFDAMLEDLSAAESGATILLHACAHNPTGVDPSMDQWKALSAALKATGAQLFFDCAYQGFASGDAERDAGGLRHFVAEGHTLMLAQSYAKNFGLYGERVGALSMVCADAAEARALESQLKAVIRPMYSSPPVHGARVVAEVLGDAQLRAKWTAECKAMADRISEMRAALKAKLADAGSTRDWAHITDQIGMFAYTGLTADQVQAMRDEFHVYCTLDGRISVAGLTPSNVDHVAKAIHAVSK

SEQ ID NO: 193 - DNA, 1251 bp, Aureococcus anophagefferens
atgaaactcgcatacttcgcgtcgctcgcgacggcccaggagtgcatcagccgctggggcgacgtcgccgtgccgccggcggacccggtgctgggcatcaaggcccagttcgtcgccgacgacacgccgacgaagatcgggctgagcgtgggcgcctaccgcgacgacgacggcaacccctgggtcctgccgcccgtcgaggccgcgcgcgagaggctcttcggccccaacggcacgacgacgcacgagtacctgagcatcgacggcttcgagcgctacaacaagctcgcgcagggcctgctctacggccccgaggaggcgaaccacgacgtcgtcaccgtgcaggcgttgagcggcacgggcgcgttacgcctcgccatggagttcctgaaccgccactacccgggcccgcggaccgcgtacatccccgccgtcacgtggagcaaccactggaacattttcaaggacgcgggctgggccgactcgcggccctacacctacctcgacaaggcggggctgcggttggagtggtcgagtttgttggcggacctcgaggcggcgccggaggggtccgtggtgttgctgcatctctgcgcgcacaacccttcgggcgtcgacccatctcgcgaccagtggaaggagctcgcggcgttggtcaagcgcaagggtctgttcccgctcttcgactcggcctacctcggcttcgcgacgggcgatctggacgccgacgcgtggcccttccgctactttttgcagcagggcttggcgccgtgggcgtgcgtgtccttctcgaagaacttcgggctctacagcgagcgcacgggcgccgtccacgcgaccgtcgcgtcgccccacgaggccgacgccgtgcggggccacctgaaaaaggtcgcgcgcgccatgtactcgaacccgccggccttcggcgcgcgcgtcgtcgccgcggtcctcgacgacccggacctcaaggccgcgtggctcgacacgctcaaggtcatgtcgagccgcatcggcgacatgcgcacggcgctccgggccaagctcgactcgctggacacgggccgcgactggagccacatcacgtcgcagatcggcatgttctcctacacgggcatgaccaagtccgaggtcctcaagatccgcgagaagcaccacgtctacatgctcgagtcgggccgcatctccatggccggcatcaacacgaagaacgtcgaccagctcgccacggccatcgccgacgtcctcgagtag

SEQ ID NO: 194 - protein, 431 aa, Aureococcus anophagefferens
MLVAPRRAAGSARALGLFAGVEAVPQDPILGLVAEFKADAFPAKVNLAQGAYRTEGGEPLLLEAVREAERRVVARGASKEYLPVEGLRSFVDAAAAFALGADSPALLDGRVASLQALSGTGSLRVCAEMLRDVAGVAEVHLPRPSWANHAAIFAKAGLAVGDYAYLDATRTSLDFEAMVADLERLPPDSVVLMHAAAHNPSGVDPTRDQWRALADLFAEKKLVPLFDTAYQGFASGDEEADAFAVRLFEARGHAPILCQSFAKNLGLYGERVGAVHVVCDSEAEAANLLSRVKQLVVRPMYSSPPLHGASLAAEVLGDGELRERWRGELLAMAQRIVDVRAALRGELERLDAAPPGAHGWRHITDQIGMFAFTGLTAPQVRSMRAVEHVYCTENGRMSLAGLAAADVPYVAAAVKRATDAIPYEARVAVAA

SEQ ID NO: 195 - DNA, 1556 bp, Emiliania huxleyi
atgtcgtcgcacgtgctgaatcgctcccacctccttctctcccgctcccgcagcacggtcgccgctgccgccgccaccgcctctcgccactctgcgtggcagggcacccaggcggtgccggccgacccgatcctcggactcgtcgccgccttcaaggcggacgccgctccgcgaaaggtgaacctggcgcagggagccttccgcacggacgaggggctgccacttgtcctgccgtcggtggtggaggcggagaggcgcgtgagctccgcgctcgccagcggcgccatcgacaaggagtacctcccgatcgagggcgatgccaccttccgcacactttcggcgaagctcatctttggcgacgagagcgctgcgctggcggagggccgctgcgccacgctgcagaccctctccggcaccggcgctgtgagcgttgccgccgccgcgctctgccggatggcgggcgcgcggaccatccacgtgccggacccatcgtgggggaaccacgggcacatcttcaggagcgccgggctcgaggtgcagaactacgcctacctggaccaccgcacaggcaccacactcgactttgacggcatgcgcgccgcactcagcggcctgcctcgcggctccgtggtgctgctgcacgcctgcgcgcacaacccgaccggaatcgacccatccggagagcagtggcaggagctggccgcgctcttcgcgggtcgcgggcttgtcgcgctcttcgactctgcctaccagggctacgcgagcggcgacctcgacgccgacgccgcctcggtgcgcgcctttgaggcggcgggcgtcctcccggtggcgtgccagtcatacgcgaagtcgctcggcctatacggcgagcggattggcgcggtcaacttcgtgtgcgcgtcgcgcgaagaggcggaggcggtgctgagcaccgtcaagcagaccatcgtgcgccccgcctactcgtcgccgccgctgcacggcgcacgccttgcggccgaggcgctcgccccctcgacagcgtcggtctcggcacccgccggaggcagcacgcccctctccccccgccggcaggtactcggcgacgcggcgctctttgcgcagtggcgcggcgagctgcgtgggatggcgaatcgcgtgcaccgcatgcgcgtgctgctggcggacgcgctgcgcgccgagggcgcgccctcgcccgacggcggcgattggggccacgtcgtcgaccagatcggcatgtttgcgtacacggggctgagcgcgagccacgtggattcgctgcgcgagaggcgccacgtctacctcacccgcgacggccgcatgtcgatggcggcaatgaagccggccgacattgagtacgttgcgcgggcggtgcgctccgtgttggcggagtgagtgccggatggagagcgggaggcatccggccaggaagcaggacgtcgatcgtgattggccttcacatcaccgcaagccggcgcgatactccccacgaggttgtacgtgcgtaaccgcaaccgcgcaacgtacaaatgctcttgttacgcgcaccggggctt

SEQ ID NO: 196 - protein, 464 aa, Emiliania huxleyi
MSSHVLNRSHLLLSRSRSTVAAAAATASRHSAWQGTQAVPADPILGLVAAFKADAAPRKVNLAQGAFRTDEGLPLVLPSVVEAERRVSSALASGAIDKEYLPIEGDATFRTLSAKLIFGDESAALAEGRCATLQTLSGTGAVSVAAAALCRMAGARTIHVPDPSWGNHGHIFRSAGLEVQNYAYLDHRTGTTLDFDGMRAALSGLPRGSVVLLHACAHNPTGIDPSGEQWQELAALFAGRGLVALFDSAYQGYASGDLDADAASVRAFEAAGVLPVACQSYAKSLGLYGERIGAVNFVCASREEAEAVLSTVKQTIVRPAYSSPPLHGARLAAEALAPSTASVSAPAGGSTPLSPRRQVLGDAALFAQWRGELRGMANRVHRMRVLLADALRAEGAPSPDGGDWGHVVDQIGMFAYTGLSASHVDSLRERRHVYLTRDGRMSMAAMKPADIEYVARAVRSVLAE

SEQ ID NO: 197 - DNA, 1392 bp, Emiliania huxleyi
acctagcacggcgacgcctcggcgcatccgcagaggtgctagttcgcacctcttcctgccgcatgggcatgagatcgtacatgacctggaacgaggtgcccgccgctcccttggaccccatcctcggcgtcaaccagaaatttcaggctgacacatccgcggaaaaggtcaacgtgtcgatcggcgcctaccgtacggatgagggcaagcccatggtgctcagctgcgtcaagaaggcggaggcgctgctactggagcagagtgacctcaacaaggagtacctgcctcagcgcggtgacgccacctacgttcagctctgccagaagatgctctttggggagaagtcaaagctgctggcgagcggggtggtggcgacggcgcagacgctgtcgggcacgggcgcgctgcggctcggcgccgagttcatgaagaagttcgccaagggcaagacggtctacatctccaatccgacgtggggcacgcacaactccatcatgacccaggctggggtgcccttctctcactaccgctactggaacgccgcgggccgtgacctcgacctggcaggcatgctggaggacatcgaggcggcgcccgagggcagcgtgatcatgctgcacgccgcggcccacaacccgaccggggtggacccgaccgcggagcagtggggcgagatcatgaccgtctgcaaggcgaagaagcacgtctgctggttcgactcggcgtaccagggcttcgcgacgggcgacttggacatcgacgccaccgcgatgcgcgcctttgccgacgaggggttgccgctcttcgtcagccagtccttcgccaagaactttggcctctacggcgagcgcgtcggcaccttctcaatcacttgcgacacgcccgaggccgtcaaggcggtcatgtcgcagctcgacatcatcatccgcaacctgtactccaacccgcccaagcacggcgcaaacatcgtcaagaccgtgctctccgaccccgcgctgtaccaggagtggcgcgacgagctcaaggccatgtcattgcgcatccaggacatgcgcacggcgctgtacgacgagctcaccagcctcggcacgccgggcagctggacgcacatcacctcgcagatcggcatgttctccttcaccggtctcagcccggagcagtgcacgcagatggtcgagaagcaccacgtgtacatgctgaacaatggccgcgtctccatggccggcgtcacctcgaagaacgtcaagtacatcgccaaggccatcgacgacgtggtgcgcaacttctgagagcgttgacgattgtcccgccccgcgcggccggttgcgctgtgcttgcataatggtccatttacgtgtgtggaggcagaactacataggagacagagagaga

SEQ ID NO: 198 - protein, 408 aa, Emiliania huxleyi
MGMRSYMTWNEVPAAPLDPILGVNQKFQADTSAEKVNVSIGAYRTDEGKPMVLSCVKKAEALLLEQSDLNKEYLPQRGDATYVQLCQKMLFGEKSKLLASGVVATAQTLSGTGALRLGAEFMKKFAKGKTVYISNPTWGTHNSIMTQAGVPFSHYRYWNAAGRDLDLAGMLEDIEAAPEGSVIMLHAAAHNPTGVDPTAEQWGEIMTVCKAKKHVCWFDSAYQGFATGDLDIDATAMRAFADEGLPLFVSQSFAKNFGLYGERVGTFSITCDTPEAVKAVMSQLDIIIRNLYSNPPKHGANIVKTVLSDPALYQEWRDELKAMSLRIQDMRTALYDELTSLGTPGSWTHITSQIGMFSFTGLSPEQCTQMVEKHHVYMLNNGRVSMAGVTSKNVKYIAKAIDDVVRNF

SEQ ID NO: 199 - DNA, 2045 bp, Emiliania huxleyi
atggttggggggctgctgctgctccacgccgccgcgggcgtggttctgagctcgtacctctcgaaggtgccgcagggtgcagcggacaagatcctcggcatcgcacaggccttccagcgcgacgagcgggcggacaaggtcaacctcgtcgtcggcgcataccgcgacggcggcgggtctccgtgggtgttgccgacggtccgcgaggccgagcagcggctgatcgcgcgcgggcagaacaaggagtacgcgagcatcgtcggcgtgcccgccttcctggaccgcgcgctcgagtttgcgtacgggcccggctgcacggcgctgagcgagggccgcgttgcggcggtccagacgctgtcgggcaccggcgcgtgccgcctggcggcggacttttacgcgcgctttctcccgccgggcaccgccgcctacgtgtcggagcccacctggcccaaccacatccccatctttgagactgcgggcctcgaggtgcgcaagtaccgctacctcggcgccgacggccggttcgacgtggagggtatgctggaggacatcgggcaggcgccggccggctcggtctttgtgctccacgcgtgcgcgcacaacccgaccggcgttgaccccaccgccgccgactggaagcgcatctccgacgcgctgcttgcggccggccagcacatcctcgtcgacatggcgtaccagggcttcgcgtccggggacgcgcggcgggacgcggcggcgctctccctcctcgccgaggcgggccactcgctcgccctcgcgcagtccttcgcgaagaactttgggctctacggcgagcgagttggctccctctcgctggtgtgcgccgacgcggccgaggcgtcgcgcgtcgagtcgcagctcaaactgctgatccgtccgatgtactcctcgccgcccatccacggcgcgctgctcgtcaacgaggtgctctccgacgcggcgttgcgcgcccagtacgacgacgagtgcgcgtcgatggcgcggcgcatcagcgacatgcgcgcgctgctcgtcgcggagctcagcgcggcggggtcgcagcgggactggagccacgtgacggaccagattggcatgttcgcgtacaccggcctcaccgccgcacagtgtgacgcgctgatggaggagcatgcggtctacctcacccgcgacgggcgcatttcgatggcgggcgtcaacgagcagaacgccggtgtcatcgccgcggcgatcgtcgccgtcgcgggctgagctgagctgccgaggccgtcgttctctcctcgatcggctaggagcttctggcggccaggcaccgttcagacctgcctcctaccggggggatccacatccaggtgcagttttgcgcgtggtccgtggaagaggctttctgtacacacacaagtatacacagagggtgttagaaggatgccgaccccgaacgcgaggtacgtacagatgtgcgcgctctctagcgcgctctccacggctcgccgactagaggcgatgcctcactcgcactgcgagctcctgcgtcgtatacctcgcacactctcacactgtgctcgatcctcgaaggttgcccgcagcacgcattctgcaacaagcgggaatcgccgatcgtgtctagtagtggtcaaaactccactctcgctgctgctgctgcctgcccgcctcgcggcgagaggcgaggcgattaggcgagctcgggcgcgaggatggagacgggcgaaacgggcgagggctgcagcgccagaggcggcggcttggacacccggttggtcaagtcggcgagaatcttgtcggaggccgcgatggatgggggtgcgacctcggagtagctcttgacgaccggcggcaagcagaagacaaagtcgcgaatggcccgcacgcttccaaaggcacgccagtcgcgcgtgagcacgcggcagccggcggcacgttgatcgccggccaactgccgcagcccgacctcgacgccgcgcagttcctcgagagggcggcgcggtgccggcgtgcgagctaggcgcatctcggcgggcacatcc

SEQ ID NO: 200 - protein, 416 aa, Emiliania huxleyi
MVGGLLLLHAAAGVVLSSYLSKVPQGAADKILGIAQAFQRDERADKVNLVVGAYRDGGGSPWVLPTVREAEQRLIARGQNKEYASIVGVPAFLDRALEFAYGPGCTALSEGRVAAVQTLSGTGACRLAADFYARFLPPGTAAYVSEPTWPNHIPIFETAGLEVRKYRYLGADGRFDVEGMLEDIGQAPAGSVFVLHACAHNPTGVDPTAADWKRISDALLAAGQHILVDMAYQGFASGDARRDAAALSLLAEAGHSLALAQSFAKNFGLYGERVGSLSLVCADAAEASRVESQLKLLIRPMYSSPPIHGALLVNEVLSDAALRAQYDDECASMARRISDMRALLVAELSAAGSQRDWSHVTDQIGMFAYTGLTAAQCDALMEEHAVYLTRDGRISMAGVNEQNAGVIAAAIVAVAG

SEQ ID NO: 201 - DNA, 1376 bp, Phaedactylum tricornutum
ttctccatctcgctaacaatcatataatgaagtttgccctgcttgccgtgtgtgtcctttccattcacgtagcttgtgcgctctcgctcaagactccggcggccaccgcggcaacggcagcctccttatggaaagatctcgaagctggtccaccggacgctattctcggtatcgcccaggcctttcgggcctccaccgatccccgcaaggttaacgtgtgtgtgggtgcgtaccgggacgccgaaggtaatccttgggtacttccctccgttcgagcagccgaacaggtgttaatggcggacaacgacaacaaggagtacctgcctatcgaaggtgacgcggattttgtcaacaaggccctggcgtttgcctacggcgacgaaatggatgttcatcgcatagctggagtgcaaacgttgagtgggactggagcttgtcgaattgggggacagtttttgagcacctttttgcctggacggacgatttacattcccacacccacgtggggaaaccattggaaaatattcgctgaatgcggtttgcaagccgcaccataccgttactacaatcgtgccaccaacgcgctggatttggacggattgctggaggatttacaggaagccgaggacggctctattattctgctgcatgcctgtgcgcacaatcccaccggctgcgaccctacattgaaagattggcaacgcattgccgatgttttggaagaaaaatcgcatgtggtctttttcgattcggcgtatcagggctttgcctcgggcgacggcgaaaaggacgccgccgccttgcgctacgtggtgaagcgtgggttgcccgtcttactagcgcagtcgtttgccaaaaatttcggactctatggagaacgctgcgggaccctgtcggtggtttgtggagatgcggatcaaaaggaccgtatcctgtcgcaactaaagtgcatcattcgaccaatgtacagttccccaccgaaacacgggagtagcatcgtgaggacggtattgtcagacgagaagctgacatctcagtactacaaagaatgcgccaccatggcggatcgtattttggacatgcgcaccaagcttgtaaccaaattgtcggaagtaggctccaagcatgattggtcgcacgtgacgggccaaattggtatgtttgccttcaccggcatgtccaaagaaatgtgtgaccagctgacgaacgaatacgaaatctatttgacgaaagatgggcgtattagcattgcgggtttgaatgatcagaatctcgagtacgtggcgaaggctatccacgctgtcacagatggccagagcattactaccgcatgagcaattgaacccgtgtaataaataaattttggtaaataagtg

SEQ ID NO: 202 - protein, 435 aa, Phaedactylum tricornutum
MKFALLAVCVLSIHVACALSLKTPAATAATAASLWKDLEAGPPDAILGIAQAFRASTDPRKVNVCVGAYRDAEGNPWVLPSVRAAEQVLMADNDNKEYLPIEGDADFVNKALAFAYGDEMDVHRIAGVQTLSGTGACRIGGQFLSTFLPGRTIYIPTPTWGNHWKIFAECGLQAAPYRYYNRATNALDLDGLLEDLQEAEDGSIILLHACAHNPTGCDPTLKDWQRIADVLEEKSHVVFFDSAYQGFASGDGEKDAAALRYVVKRGLPVLLAQSFAKNFGLYGERCGTLSVVCGDADQKDRILSQLKCIIRPMYSSPPKHGSSIVRTVLSDEKLTSQYYKECATMADRILDMRTKLVTKLSEVGSKHDWSHVTGQIGMFAFTGMSKEMCDQLTNEYEIYLTKDGRISIAGLNDQNLEYVAKAIHAVTDGQSITTA

SEQ ID NO: 203 - DNA, 1322 bp, Phaedactylum tricornutum
ttcgaaaaatcagagcttcgattttcacaccgcaagcaaccatgctgaagcaaatctctcaatcgttccttcgtcccacagctcgatgtgtgtcagcgtcctcaagggttcgattcatgagcgccagtccctgggccgactatgaaatggcaccctttgaccccattatcggcctgaacgaggagtacagcaaagatgactttccacaaaaagtaatcgttggagttggtgcctaccgcgacggaaacggaaagccttatgtgcttccctgtgtccgggaagcagagaagaagatgatggagcagaacctcgacatggagtattcaggtatcgctggagatgccaagttcgtggaattagcactcaagtttggatacggcaaagactcgaaacctctaggagagaaccgcattcaaggtgtgcaggcactttctggtacaggcggcctccgcgttatgggggagctcctgcgtaaacacggccacacccatatttatgtgccgaatccaacgtggggcaatcacattcccattttcgtcaactctggattggaagttcgtaaatacaggtactatgatgccaagaactcggacctcgactttgacggtatgattaccgacatcaaggaaatgccgacggggagcactgtactactgcatgcctgcgcacacaacccaaccggtatggaccctactttggaacaatggaaagagctcagtgatataatcaaaacgaaaaagcttctgccattctttgattgtgcataccaagggtttgcttctggagatgccaacatcgacgctgcatcagtccggatgtttgtcgaagacggacaccttttagcaatggtccagtcgttttccaagaactttggtttgtatggtcatcgagtcggtacgctatcagttgttggcgagtccgaagcggaagccaagcgtgtgcaatctcagctcaaaaccgtaatccggcccatgtactccaaccctccgcgtcatggtgcacgtatcgtttcaactatcttgtcggaccccaagcttacccaagacttcctgattcaatgcaaggaaatggcagaccgaattcataccatgcgtggattgcttcgcagtaacttggagcaggctggctcgacacacaattgggagcacattactcgacagatcggtatgtttgcctacagtggcctttcgaaagaccaggtattggagatgcgtcacaagcaccatgtctactgtactgcggacggtcgaatttccatggcgggtgtaacttctggaaatgtggactacattgcgcaagccattcatgccgtttccaagtaa

SEQ ID NO: 204 - protein, 426 aa, Phaedactylum tricornutum
MLKQISQSFLRPTARCVSASSRVRFMSASPWADYEMAPFDPIIGLNEEYSKDDFPQKVIVGVGAYRDGNGKPYVLPCVREAEKKMMEQNLDMEYSGIAGDAKFVELALKFGYGKDSKPLGENRIQGVQALSGTGGLRVMGELLRKHGHTHIYVPNPTWGNHIPIFVNSGLEVRKYRYYDAKNSDLDFDGMITDIKEMPTGSTVLLHACAHNPTGMDPTLEQWKELSDIIKTKKLLPFFDCAYQGFASGDANIDAASVRMFVEDGHLLAMVQSFSKNFGLYGHRVGTLSVVGESEAEAKRVQSQLKTVIRPMYSNPPRHGARIVSTILSDPKLTQDFLIQCKEMADRIHTMRGLLRSNLEQAGSTHNWEHITRQIGMFAYSGLSKDQVLEMRHKHHVYCTADGRISMAGVTSGNVDYIAQAIHAVSK

SEQ ID NO: 205 - DNA, 1323 bp, Thalassiosira pseudonana
atgggtggctggtccaccactactgttcgtggttttgcaggtgctccttcaccttgggctgagttcccacaagctcccccggatccaattatcggattgactgaggcttatctaagcgatgactttccagaaaaggtcaatgttggagttggagcttatcgctgtgatcaaggaatgccgttcgtccttcccgtcgtacgtgaagcagagaatgaaatcaacttggaagaagttgatcacgaatactctggtattgccggatgccccaactttgtcaaccttgcattgcgtttttgctacggggaggacagtgttccgttgaaagagaagcgagtgtcaggtgttcaaactctttctggaacgggagggctacgtgtgtttggtgaagtgctacaccagttcggtcacaagcacatctacgtcccaaacccaacttggggtaatcacatcccaatatttacaaacgctggattggaagtacgaaaatatcggtactacgacaacgcaacatctagcttggactttgatcacttgattgaggatatgaaacaaatgccagatgggagctgcattctcttgcatgcatgtgctcacaatcccactggaatggatccaacgcctgagcaatggaaacaaatcagcaacgctgcaaaggagaagaatcttctaccattctttgattgtgcctaccagggatttgcttctggagatgctcgcaaagatgctgcagctgtgcgtatgtttgttgaagatggacacaaaattgctctcgtgcagtcgttctcaaagaactttggactgtatggtcaacgcatcggtgccttatccattgtcgccgattccccagaggaagcacaacgagtactaagtcagctcaaagttcatattcgtccgtcgtactctaaccctcctcgtcatggtgccagaatcgtcagcaagattctcgcaagcaaggagaagactgatcagtttgtaaaacagtgcatgggaatggcgaaacgtattgactcaatgaggagcaagctgaggacagcattggaggagcttggttctagcagagcatgggatcatatcacaaaacagattggcatgtttgcttacagtggcatgtccaaggatgaagtgattgaacttcgtgagaagcatcatatctactgcactttggatgggagaatcagtatggcaggtgttacgtcaaagaatgtggattacatcgctcgtgcaatctacgacgttacggagaagaagtgagggatagggttgagttgatgaaagagttgtcagtttgggttgcatgttaaacatctaaaaagatattacaac

SEQ ID NO: 206 - protein, 416 aa, Thalassiosira pseudonana
MGGWSTTTVRGFAGAPSPWAEFPQAPPDPIIGLTEAYLSDDFPEKVNVGVGAYRCDQGMPFVLPVVREAENEINLEEVDHEYSGIAGCPNFVNLALRFCYGEDSVPLKEKRVSGVQTLSGTGGLRVFGEVLHQFGHKHIYVPNPTWGNHIPIFTNAGLEVRKYRYYDNATSSLDFDHLIEDMKQMPDGSCILLHACAHNPTGMDPTPEQWKQISNAAKEKNLLPFFDCAYQGFASGDARKDAAAVRMFVEDGHKIALVQSFSKNFGLYGQRIGALSIVADSPEEAQRVLSQLKVHIRPSYSNPPRHGARIVSKILASKEKTDQFVKQCMGMAKRIDSMRSKLRTALEELGSSRAWDHITKQIGMFAYSGMSKDEVIELREKHHIYCTLDGRISMAGVTSKNVDYIARAIYDVTEKK

SEQ ID NO: 207 - protein, 4 aa, Artificial sequence
  ASPAT polypeptide motif 1
NPTG

SEQ ID NO: 208 - protein, 17 aa, Artificial sequence
  ASPAT polypeptide motif 2
IVLLHACAHNPTGVDPT

SEQ ID NO: 209 - protein, 17 aa, Artificial sequence
  ASPAT polypeptide motif 3
SRLLILCSPSNPTGSVY

SEQ ID NO: 210 - DNA, 50 bp, Artificial sequence
  primer 1
ggggacaagtttgtacaaaaaagcaggcttaaacaatggcgtcgtcgtcc

SEQ ID NO: 211 - DNA, 50 bp, Artificial sequence
  primer 2
ggggaccactttgtacaagaaagctgggtatgctaccatcattcacttca

SEQ ID NO: 212 - DNA, 56 bp, Artificial sequence
  primer 3
ggggacaagtttgtacaaaaaagcaggcttaaacaatggattccgtcttctctaac

SEQ ID NO: 213 - DNA, 50 bp, Artificial sequence
  primer 4
ggggaccactttgtacaagaaagctgggtaaaaatgtatggtcgctagtt

SEQ ID NO: 214 - DNA, 58 bp, Artificial sequence
  primer 5
ggggacaagtttgtacaaaaaagcaggcttaaacaatgaaaactactcatttctcttc

SEQ ID NO: 215 - DNA, 49 bp, Artificial sequence
  primer 6
ggggaccactttgtacaagaaagctgggttggtgttcagtttctcagac

SEQ ID NO: 216 - DNA, 56 bp, Artificial sequence
  primer 7
ggggacaagtttgtacaaaaaagcaggcttaaacaatggcttctttaatgttatct

SEQ ID NO: 217 - DNA, 50 bp, Artificial sequence
  primer 8
ggggaccactttgtacaagaaagctgggttgtcatctactgagatggaag

SEQ ID NO: 218 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 219 - DNA, 1179 bp, Oryza sativa
ttgcagttgtgaccaagtaagctgagcatgcccttaacttcacctagaaaaaagtatacttggcttaactgctagtaagacatttcagaactgagactggtgtacgcatttcatgcaagccattaccactttacctgacattttggacagagattagaaatagtttcgtactacctgcaagttgcaacttgaaaagtgaaatttgttccttgctaatatattggcgtgtaattcttttatgcgttagcgtaaaaagttgaaatttgggtcaagttactggtcagattaaccagtaactggttaaagttgaaagatggtcttttagtaatggagggagtactacactatcctcagctgatttaaatcttattccgtcggtggtgatttcgtcaatctcccaacttagtttttcaatatattcataggatagagtgtgcatatgtgtgtttatagggatgagtctacgcgccttatgaacacctacttttgtactgtatttgtcaatgaaaagaaaatcttaccaatgctgcgatgctgacaccaagaagaggcgatgaaaagtgcaacggatatcgtgccacgtcggttgccaagtcagcacagacccaatgggcctttcctacgtgtctcggccacagccagtcgtttaccgcacgttcacatgggcacgaactcgcgtcatcttcccacgcaaaacgacagatctgccctatctggtcccacccatcagtggcccacacctcccatgctgcattatttgcgactcccatcccgtcctccacgcccaaacaccgcacacgggtcgcgatagccacgacccaatcacacaacgccacgtcaccatatgttacgggcagccatgcgcagaagatcccgcgacgtcgctgtcccccgtgtcggttacgaaaaaatatcccaccacgtgtcgctttcacaggacaatatctcgaaggaaaaaaatcgtagcggaaaatccgaggcacgagctgcgattggctgggaggcgtccagcgtggtggggggcccacccccttatccttagcccgtggcgctcctcgctcctcgggtccgtgtataaataccctccggaactcactcttgctggtcaccaacacgaagtaaaaggacaccagaaacatagtacacttgagctcactccaaactcaaacactcacacca

SEQ ID NO: 220 - DNA, 1098 bp, Populus trichocarpa
atgaaggagaggcagcgttggagagctgaggaggacgctttactacgtgcatacgtgaaacaatatggtccaagggaatggaatcttgtatcacagcgcatgaacacacccctaaacagggatgctaaatcttgcttagaaaggtggaagaactacctcaaaccagggataaagaaaggatctcttacagaagaagagcagagtcttgtcattcggcttcaggcgaaacacgggaacaaatggaagaaaattgcagctgaagttccaggtcgaacagctaagagactaggcaagtggtgggaggtgttcaaagagaagcaacagagagagctgaaggaaaataacaagacagttgagccaattgacgagggcaagtacgataggattttagagacttttgctgagaagctagtgaaagagcgcccttctccagcatttgtaatggccacttcgaatgggacctttcttcatccccatccccatccccctccccatccccatccatctactccagcaccaactatgctccccccttggctttctaattctaacagcacctccactgtcaggccaccatccccctctgtaacgctaagcctctctccatcaacagttgcggcatcccctccaatcccatggcttcaacctgagagaggtccggaaaacactcctcttgttttgggcaatttgccacctcatggaatagtccctgtttgtggtgagagcttcttgatgtctgagttggtcgattgctgtagagaattggaagaagggcaccgcgcttgggctgcacacaaaaaggaggctgcctggaggctaagaagggtagagttacagctggagtcagagaggtcatgccgaaggagggagaaaatggaagagatagagtcaaagatcaagtctcttagggaagaagaaaaggcatctcttgataggattgaagcagagtacagggaacaattaacagggcttagaagggatgcagaaaccaaggaacagaaattgtccgaccagtggactgcaaagcatttgcgtcttactaagtttctcgaacagatgtcttgcagacctaggctttctgagcctaatagtcgttaa

SEQ ID NO: 221 - protein, 365 aa, Populus trichocarpa
MKERQRWRAEEDALLRAYVKQYGPREWNLVSQRMNTPLNRDAKSCLERWKNYLKPGIKKGSLTEEEQSLVIRLQAKHGNKWKKIAAEVPGRTAKRLGKWWEVFKEKQQRELKENNKTVEPIDEGKYDRILETFAEKLVKERPSPAFVMATSNGTFLHPHPHPPPHPHPSTPAPTMLPPWLSNSNSTSTVRPPSPSVTLSLSPSTVAASPPIPWLQPERGPENTPLVLGNLPPHGIVPVCGESFLMSELVDCCRELEEGHRAWAAHKKEAAWRLRRVELQLESERSCRRREKMEEIESKIKSLREEEKASLDRIEAEYREQLTGLRRDAETKEQKLSDQWTAKHLRLTKFLEQMSCRPRLSEPNSR

SEQ ID NO: 222 - DNA, 1497 bp, Antirrhinum majus
tttttacccgcgtgacaactttttactctcttttaatcagagtttcttgttctcagccttagagaaaaaaaagggctgttctttcatggtacagataattatgggctttggagaaaactttgtttcttgaatgtcagtataaatatgaaaattttggggcaatgggcaaaggtttttgcgagtggaaatgaaggaaaggcaacgatggagacctgaagaagacgccttgttgcgtgcttatgtaaaagaatacggccccagagattggcacctagtgacacaacgcatgaacaaacctctcaaccgggacgcgaaatcctgtttagaaaggtggaaaaactatttaaaacccggaatcaagaaagaatcccttacacaagaggagcagattctcgttattaatctacaagcgaaacacggcaacaagtggaaaaagatcgctgctgaagttccaggacgaactgccaaaagacttggtaagtggtgggaagtttttaaagagaagaagcaacgcgaagaaaaggacaacaagaagattaccgaaccgattgaagaaggaaaatacgatcgtatattggagacgtttgcagagaagatagtaaaagagcgagtcgtttcaagaattattacaatgccgccaacttcaaatagtggatttcttcaaaacgatccgtctccgcattctgcacaatcggtgttacccccatggctagctagttctagcatgacaacaaccattaggccacaatccccgtccgtgactttatccctctcgccctctgtagtgcctcctgccccagcaatcccctggctacaccctgataacaccactcatggtccgagcaatttgtcgtctcttggggtagttgcgccttttatgggagaaaaccatatagttcctgaacttttagagtgctgtcgggaattggaagaagggcagcgtgcatgggcggcgcacagaaaagaagcagcttggagactaaaaagggtagaactgcagttggaatcggagaaagcatgtcgaaggagagagaaaatggaggagattgaagcgaaaatgaaagctcttagagaagaacagaaggctagtctcgatcggatcgaagcagagtacagggaacaattagccggattgagaagagaagcggaagtgaaagaacagaagctggctgagcaatgggcggctaagcacttgcgtctaactaagtttctcgagcagacggggtataggtcgattgctggtgagctgaatggtcgataaaggcgttctgctttgttgttatgttggtctacttcttctataacagatatatggtatttgcttgagttaatttcttaggtcttgaatcaaccttggctagattgtttttgcttttcattatagatctgtgtgatctgtgtgatcttgatttggattttggtacacctttaaaggttggtttatgttattgagaatgtgatgaggaactatggttaaaatagagaataaaaaaaaaa

SEQ ID NO: 223 - protein, 357 aa, Antirrhinum majus
MKERQRWRPEEDALLRAYVKEYGPRDWHLVTQRMNKPLNRDAKSCLERWKNYLKPGIKKESLTQEEQILVINLQAKHGNKWKKIAAEVPGRTAKRLGKWWEVFKEKKQREEKDNKKITEPIEEGKYDRILETFAEKIVKERVVSRIITMPPTSNSGFLQNDPSPHSAQSVLPPWLASSSMTTTIRPQSPSVTLSLSPSVVPPAPAIPWLHPDNTTHGPSNLSSLGVVAPFMGENHIVPELLECCRELEEGQRAWAAHRKEAAWRLKRVELQLESEKACRRREKMEEIEAKMKALREEQKASLDRIEAEYREQLAGLRREAEVKEQKLAEQWAAKHLRLTKFLEQTGYRSIAGELNGR

SEQ ID NO: 224 - DNA, 1303 bp, Aquilegia formosa x Aquilegia pubescens
ggaaatgtattgcagaagaagagctgtgttgtttagttaagagaacttattagccatatacattatgaagaattcaaccgcatggactgtgatgtttgttattggaaatgaaggagaggcagcgctggagagctgaagaggacgcccttttacgtgcatatgtgaagcaatatggccctagggagtggaatcttgtgtctcagcgcatgaacacacctctcgatagagatgctaaatcttgcttagaaaggtggaagaattacctcaaaccagggatcaagaaaggttcactcacagaggaggagcagcgtcttgtcatccgtcttcaggctaagcacgggaacaagtggaaaaaaattgcagctgaagttccaggacgtaccgcaaagagactaggcaagtggtgggaagtgttcaaggagaagcaacaaagggagcagaaagagaacaacaaagccccagagccaattgaggagggaaagtacgacagtattcttgagacatttgctgagaagctagtaaaagagtgtccaaaccctcccttcttaatggctacatctaatggtggttttcttcactctgatccacctgcacccccgccaactatgcttcctccatggatggctagttcaaacggaacaactgtaaggccatcttctccgtcagttacattgaccctgtcaccttctacagtcactcctcccccaagcatcccatggcttcagtctgctgatagaggggcagcagaaaatccctctcttggcttaggcagtttgtcgtctcatgggtcaggttctactggtggagataaccatatggttgcagaccttgtggagtgttgcagagagttagaagagggacatcgagcttgggtagcacacaaaaaagaagcagcatggaggctgaagagggtggaactacaacttgagtcggagaaggcatgtcggaggagggataaaatggaggaaattgaatctaagataagggcccttagggatgaacagaaggtaacactggagaggattgaggcagagtatagagagcaattagcaggtctaaggagggatgctgacgctaaggagcagaagttagcagatcaatgggctgggaaacacatgcgtcttacaaaatttctggaacagatgggatgccgaccaaggcttattgaaccaaatggcagatgaatttgtttggtcctccaatagacgataactttgtagaatgcataactgttatgttgttcctctgatctgcatctctcatgaaactcctgcttgcttactggtgactaggttgtattctg

SEQ ID NO: 225 - protein, 358 aa, Aquilegia formosa x Aquilegia pubescens
MKERQRWRAEEDALLRAYVKQYGPREWNLVSQRMNTPLDRDAKSCLERWKNYLKPGIKKGSLTEEEQRLVIRLQAKHGNKWKKIAAEVPGRTAKRLGKWWEVFKEKQQREQKENNKAPEPIEEGKYDSILETFAEKLVKECPNPPFLMATSNGGFLHSDPPAPPPTMLPPWMASSNGTTVRPSSPSVTLTLSPSTVTPPPSIPWLQSADRGAAENPSLGLGSLSSHGSGSTGGDNHMVADLVECCRELEEGHRAWVAHKKEAAWRLKRVELQLESEKACRRRDKMEEIESKIRALRDEQKVTLERIEAEYREQLAGLRRDADAKEQKLADQWAGKHMRLTKFLEQMGCRPRLIEPNGR

SEQ ID NO: 226 - DNA, 1490 bp, Arabidopsis thaliana
ctggttttaaaagcctctctcactttggtcttttcgttttctctcttccattttctccaactatataaaaaaaaaaaagtgagagagagagcaaatctgtgtgatggaagttgctcttgagtttgggattatttatcttttcaatatcatttgatgaagaaggatggtgagatgggaagaagtgatgtcaggaggagtaggagatgaaagagagacaacgttggagtggtgaagaagatgcattgttacgtgcttacgttagacagttcggtccgagagaatggcatcttgtgtctgagcgtatgaacaaacctttgaaccgtgacgccaagtcttgtttagagagatggaagaattatcttaagccagggatcaagaaagggtctttgacagaggaagagcagaggcttgtgatccgtcttcaggagaaacacggcaacaagtggaagaagattgctgctgaggttcccgggaggacggcaaagcggttagggaagtggtgggaagtgtttaaggagaagcaacagagagaagagaaagagagtaacaagagagttgagcctattgacgagagtaagtacgatcggattctcgagagtttcgctgagaagcttgtcaaagagcggtctaacgttgtccctgctgctgccgctgctgcaacggttgtgatggctaattcgaatggagggtttttacattctgaacaacaagttcagcctcctaacccagtgatcccgccttggttagctacttctaacaatgggaacaatgttgttgcaaggcctccctcggtaactttgacattatcgccttccacagtggctgcagctgcgcctcaaccgccaatcccgtggctgcagcagcaacagcctgagagagcagagaacggtccagggggacttgtgttagggagtatgatgccgtcttgtagtgggagtagcgagagtgtgttcttgtcagagcttgtggagtgttgtagagagttggaggaagggcaccgagcttgggcagaccataagaaagaggctgcatggaggctaagaaggctggagctgcagctagagtcagagaagacgtgtagacaaagggagaagatggaggagattgaggcaaagatgaaagctcttagggaagagcagaagaacgcaatggagaagatcgaaggagagtacagagaacagctcgttggtttgaggcgagacgcagaggccaaagaccagaaactggctgatcaatggacctctaggcatatcagactcaccaagtttcttgaacaacaaatgggttgcagattagaccgcccctgaaccgtctcctaaactctttgttgtaacttgtaatgtaatgtaaggttttttttttgtttttttttgtttttttttgtctttgatcatttgggtgtctccaatgtttacttagacttttgggttccttacctcagctttgtatttgtttcttttacctttgtgttccatttatcacttcagttt

SEQ ID NO: 227 - protein, 367 aa, Arabidopsis thaliana
MKERQRWSGEEDALLRAYVRQFGPREWHLVSERMNKPLNRDAKSCLERWKNYLKPGIKKGSLTEEEQRLVIRLQEKHGNKWKKIAAEVPGRTAKRLGKWWEVFKEKQQREEKESNKRVEPIDESKYDRILESFAEKLVKERSNVVPAAAAAATVVMANSNGGFLHSEQQVQPPNPVIPPWLATSNNGNNVVARPPSVTLTLSPSTVAAAAPQPPIPWLQQQQPERAENGPGGLVLGSMMPSCSGSSESVFLSELVECCRELEEGHRAWADHKKEAAWRLRRLELQLESEKTCRQREKMEEIEAKMKALREEQKNAMEKIEGEYREQLVGLRRDAEAKDQKLADQWTSRHIRLTKFLEQQMGCRLDRP

SEQ ID NO: 228 - DNA, 1284 bp, Brassica napus
atgaaggagaggcaacgttggagtggtgaagaagatgcattgttacgtgcctacgtgagacagttcggtccgagagaatggcatctcgtctctgagcgtatgaacaagcctctgaaccgcgacgcaaagtcttgtctcgaacggtggaagaactatcttaagccagggatcaagaaagggtctttaaccgaggaagagcagaggctcgtgatccgtttgcaggagaaacacggcaacaagtggaagaagatcgccgcggaggttccagggaggacggcgaggcggttagggaagtggtgggaagtgttcaaggagaagcagcagagagaagagaaagagagtaacaagagagtcgagcctattgacgagagtaagtacgatcggatcctcgagagtttcgctgagaagcttgtgaaagagaggtcctctgttccttctgcggtgatggctagttcaaacggagggtttcaacaagctcctcctaataataataataataataataataataataataatcatgtgatccctccttggttagctacttctaacaacgggagcaatgttgttgcaagaccaccctcggtgactcttactctatcgccttcagtggctgcaacacctcctcaacagcagcctatcccatggctgcagcagcagcaacccgaggctagtccgggaggtctagtgttagggagtatgataccgtcttgtagcggtagtaatgagagtgtgttcatgtcagagctagtggagtgttgtagagagctggaggaagggcacagagcttgggcggagcataagaaggaggcggcttggaggctaaggagattagagctgcagctagagtcagagaagacaagtagacaaagggagaagacagaggagattgaggcaaagatgaaggctctgagggaagagcagaagatggcaatggagaagattgaaggagagtatagggaacagcttgttgggttgaggagagatgctgaggccaaggatcagaaactagctgatcagtggacctctaagcatatcaggctcaccaagtttcttgaacaacacatgggctgcaggcagagactattagaccggccttgacacatgaaccaaaccaccaaacacctactatgatctcttctcctctttgttgtgtaatgtaatgtaagctttttgtttttattttcatcatttggtgtctccaatgttaatcagacttttgggttccttaactcagcttttaatgtatgtgttggtttctcttctttgaaaaaaaaaaaaaaa

SEQ ID NO: 229 - protein, 366 aa, Brassica napus
MKERQRWSGEEDALLRAYVRQFGPREWHLVSERMNKPLNRDAKSCLERWKNYLKPGIKKGSLTEEEQRLVIRLQEKHGNKWKKIAAEVPGRTARRLGKWWEVFKEKQQREEKESNKRVEPIDESKYDRILESFAEKLVKERSSVPSAVMASSNGGFQQAPPNNNNNNNNNNNNHVIPPWLATSNNGSNVVARPPSVTLTLSPSVAATPPQQQPIPWLQQQQPEASPGGLVLGSMIPSCSGSNESVFMSELVECCRELEEGHRAWAEHKKEAAWRLRRLELQLESEKTSRQREKTEEIEAKMKALREEQKMAMEKIEGEYREQLVGLRRDAEAKDQKLADQWTSKHIRLTKFLEQHMGCRQRLLDRP

SEQ ID NO: 230 - DNA, 1259 bp, Cardamine hirsute
gcattttcgcacaactaaaaaaaaaatagagcaaatctgcgtcatggaagttgctctccagtctttgatcacttcccttttcaacataatttgatgaagaaggatggtgagatgggaagaagtgatgttgttgttaggaggagatgaaagagagacaacgttggagtggtgaagaagatgcattgttacgtgcttacgtaagacagttcggtcctagagaatggcatcttgtctccgagcgtatgaacaaacctttaaaccgtgacgccaaatcttgtttagaaagatggaagaactatcttaaaccagggatcaagaaaggttctttaacagaggaagaacagagactcgtgatccgtcttcaagagaaacacggcaacaagtggaagaaaatcgccgctgaggttcccggaagaacagctaaacggttagggaagtggtgggaagtgtttaaagagaagcaacaaagagaagagaaagagagtaataaaagagttgagcctatcgacgagagcaagtacgataggattcttgagagtttcgctgagaagcttgttaaagaacggtctaataatattgttgttgttcctccttctgctgggaaggttgtgatggctaattcaaacggagggtttctacaacatagtgagcagactcagcctcagcctcctaatccggtgattccaccttggttagctacttctaacaatgggaacaatgttgttgtcagacctccttctgttactttaactttatcaccttctactttggctgcttctacgcctcctccaccgcaaatcccgtggcttcagcaacaacagcagcctgagagaggagagaatggtcttgtgttagggagtatgatgccttcttgtagtggtagtagtagtagtgagagtgtgttcttgtctgagcttgtggagtgttgtagagagttggaggaagggcatagagtttggtcggagcataagaaagaagctgcgtggagactaaggaggttggagttgcagttagagtcagagaagacgtgtagacaaagggagaagatggaagagattgaagcaaagatgaaagctcttagggaagagcagaagattgcaatggagaagattgatggtgagtatagagaacagcttgttggtttgagaagagatgctgaagctaaagaccagaaacttgctgatcaatggacttctaaacatattagactcactaagtttcttgaacaaaacatgggttgcagattagaccgcccctga

SEQ ID NO: 231 - protein, 371 aa, Cardamine hirsute
MKERQRWSGEEDALLRAYVRQFGPREWHLVSERMNKPLNRDAKSCLERWKNYLKPGIKKGSLTEEEQRLVIRLQEKHGNKWKKIAAEVPGRTAKRLGKWWEVFKEKQQREEKESNKRVEPIDESKYDRILESFAEKLVKERSNNIVVVPPSAGKVVMANSNGGFLQHSEQTQPQPPNPVIPPWLATSNNGNNVVVRPPSVTLTLSPSTLAASTPPPPQIPWLQQQQQPERGENGLVLGSMMPSCSGSSSSESVFLSELVECCRELEEGHRVWSEHKKEAAWRLRRLELQLESEKTCRQREKMEEIEAKMKALREEQKIAMEKIDGEYREQLVGLRRDAEAKDQKLADQWTSKHIRLTKFLEQNMGCRLDRP

SEQ ID NO: 232 - DNA, 1471 bp, Eschscholzia californica subsp. Californica
aattagccatatgggttcttcatcgagtaccattttcgtgttaatccgtagtcgaagtaattactcacattttcacatatccttagatacagtatgaaggatttgaggcaatgggctattgtttttgctgctggaaatgaaagagagacagcgttggagagctgaagaagacgccttattacgcgcgtacgtgaaacagtatggcccaagagaatggaaccttgtttctcagcgcatgaacacacatcttgatagagacgcaaaatcgtgcttagagaggtggaagaattacctaaaaccaggcatcaagaaaggatctttgactgaggaagaacaacgacttgtaatccgtcttcaagccaaacacggtaacaagtggaagaaaattgcagctgaagttccggggcgaacggcaaagagattaggcaagtggtgggaagtgtttaaagagaagcaacaaagggagcaaaaagaaacatccaaaactattgatccaattgaagaaggaaagtacgatcaaattctcgaaacgtttgcagagaaattggtgaaagaacgaccaaatcctccattatacatgggaacctctaatgggggttatcttcagtctaatgcagctactgttccaccaccaacactacttccaccttggctttctagttctagtgccccacccacaacttcctcacctccttcggttacattaactctctcgccttctacaattgctccgtgtacttcaatgtcctggttgcagcctgataggggcggaaacgatagcaacccctctcttgtattgggtaattttccgccaacacatgttccggttcctccaagtggaggagatagattaatggttccggatcttgtagagtgctgtagggagttggaagaaagtcatagagctttggtagctcataagaaagaagcagcttggaggcttaaaagggttgaactacaactcgagtcagagaaagcatgtcggaggagagagaaaatggaagagatagagatgaaggtgagagcacttagagaagaacagaaggtgacacttgatagaatggaagccgactatcgggatcagctggctggtttaagaagggatgctgaagctaaggagcagaaactggctgatcaatgggcggcaaagcatttgcgcctaatgaagtttctagaacagatagggtgccgaccgccaagtgaacccagtggaaggtgagagtttctctatatctaagagacgtcttcgaagttaactactataacatatggtgattgtgcatattttgtcctggtgtatttgtgttagataactacttatctgttgttttattggctttttgtactccttttatgttaggattgagctaagtagaactagaacttgagttttagggtttgtaagattttcagttctcctaaataatctttgcatgtatctttaagagcagaaatttcctactttcggttt

SEQ ID NO: 233 - protein, 360 aa, Eschscholzia californica subsp. Californica
MKERQRWRAEEDALLRAYVKQYGPREWNLVSQRMNTHLDRDAKSCLERWKNYLKPGIKKGSLTEEEQRLVIRLQAKHGNKWKKIAAEVPGRTAKRLGKWWEVFKEKQQREQKETSKTIDPIEEGKYDQILETFAEKLVKERPNPPLYMGTSNGGYLQSNAATVPPPTLLPPWLSSSSAPPTTSSPPSVTLTLSPSTIAPCTSMSWLQPDRGGNDSNPSLVLGNFPPTHVPVPPSGGDRLMVPDLVECCRELEESHRALVAHKKEAAWRLKRVELQLESEKACRRREKMEEIEMKVRALREEQKVTLDRMEADYRDQLAGLRRDAEAKEQKLADQWAAKHLRLMKFLEQIGCRPPSEPSGR

SEQ ID NO: 234 - DNA, 1566 bp, Eucalyptus grandis
tatctctagcttagcttggagcttacctactgtactctgcttttcccccccctctctctctctctctcgctctgaacgtttttcagtcatcgagccgagctgaactcctctccccctctctctctctctctctgggtgacccttcttcccttttctctgcgcttccgtcgaagtgaaagagggcgccgaggttgtcgtccgagatgcgtcggagaaggacctctctcctgatttcatgagaccgaccaccacactatgaaagatctaagtttgaggcaatgggaagtggtgtctacacctggcaatgaaggaaagacagcgttggagagctgaagaggacgccttgttacgtgcatatgtgaaacagtatggcccaagggagtggcaccttgtgtctcagcgcatgaacactccccttaaccgtgatgccaagtcctgcttagagaggtggaagaactacctgaaaccaggtataaagaagggatccctcagtgaggaagaacagcgtcttgtcatccagcttcaggcgaaacacggcaacaaatggaagaaaattgctgctgagatcccgggccgtacggctaagagattggggaagtggtgggaggtatttaaagagaaacagcaaagggagcaaaaggagaacaaaggtgctttaccaattgacgaggggaaatacgatcatatattagaaaacttcgccgagaagctagtgaaggagcgatcgaccccagcacttctcatggccacagcaaatggtggcttcattcacaccgattcacctgctcttgctccaactcttctacctccatggctttcaaattctaatggcaccccaactctgaggcctccttcaccgtcagtaacccttagtctctcccctgcaacagttccagcatctcaaccgattccgtggctgcaggcagatagaggactcgatagtggttctctctcactgactggtttgcccaaccatggtccactccctacttcaggagaaaatatcttaatgtctgagcttgcagagtgctgcaaggaattggaagaagggcaccgtgcttgggctgcacacaagaaggaagcggcatggaggttgaaacgactggagttgcagttggagtcggagaaggcgtgcaggaggagggagaaaatggaagagatagaggcgaaaatcaacactctcagggaagagcagaaagcttctttggataagattgaaacagaatacagagagcagctggcaggattgaggaaagatgcagaatccaaggagcagaagctggctgaacagtggacggcgaagcatgttcagctctctaagttaatcgagcaaatcgggtttagaccccggattgcagatcatgacaggcagtgagagttaccgtgagtcgtagtcctttatatacacgtctctttcttgtgccaatcatgtcattcaagtctgcttattagaattccaagactcccttttcctacccaacaaacacctacctttacgtatatctcaataacattacagagcttctcatcctcagctaagtcctctgagacattttgtatggaaat

SEQ ID NO: 235 - protein, 356 aa, Eucalyptus grandis
MKERQRWRAEEDALLRAYVKQYGPREWHLVSQRMNTPLNRDAKSCLERWKNYLKPGIKKGSLSEEEQRLVIQLQAKHGNKWKKIAAEIPGRTAKRLGKWWEVFKEKQQREQKENKGALPIDEGKYDHILENFAEKLVKERSTPALLMATANGGFIHTDSPALAPTLLPPWLSNSNGTPTLRPPSPSVTLSLSPATVPASQPIPWLQADRGLDSGSLSLTGLPNHGPLPTSGENILMSELAECCKELEEGHRAWAAHKKEAAWRLKRLELQLESEKACRRREKMEEIEAKINTLREEQKASLDKIETEYREQLAGLRKDAESKEQKLAEQWTAKHVQLSKLIEQIGFRPRIADHDRQ

SEQ ID NO: 236 - DNA, 1242 bp, Glycine max
tcttggaaatgaaagataggcaacgttggagagctgaagaggatgctttacttcgtgcatatgtcaaacagtatggtcctagggaatggaatctcgtgtctcagcgcatgaacacacctcttaacagggatgccaagtcatgcttagaaaggtggaagaactacctcaaacccggcattaaaaaaggatctcttactgaggaagagcagcgtctagtcatcaatcttcaagcaacgcacgggaacaagtggaagaaaattgcagcacaagtccctggtcgcactgcgaagaggttagggaagtggtgggaggtatttaaggagaagcagcaaagggaaaccaaggggaatagctgcactattgacccaattagcgatagcaagtacgagcatatccttgagagttttgcagagaagctagtgaaagaaaggccttcaacatcaacatcaacatcatttgttatggctacttccaacagttcttttctgcatgctgatgcaccggctcctgcaccagccttgcttccgtcttggctttccaattccaatggcactgcacctgtgaggccaccctccccttctgtgactcttagtctttctccctcgacagtggcagcgcctcctccatggatgcagccccccgtcagaggacaggacaatgctagtcctcttgttttggggaatgtggcgcctcacggggccgttctagcatttggtgagaacatggtgatgtctgagctagtggagtgctgcaaggagttggatgaagtgcatcatgctttggccgggcataagaaggaggcagcatggcggttaagcagggtggagctgcagttggagtctgagaaggctgggcgaaggagggagaagatggaggaaatcgaagcgaaaatcaaagctctgagggaggagcaaacggctgcattggatagaattgaagcagaatatagggagcagttggcagggctgagaagagatgctgaaagcaaggagcaaaagttggctgaacaatgggctgcaaaacacttgcgacttactaagtttctagaacaggtagggtgcagatcaaggctcactgaaccaaatggaagatagagtgacatcaatcattcacaaattgggaaaatctagtttgcttttacttattattatgtcttgaatttatatgatatgaactttatagtcatagtagttttgttcctgtcatttttctaaaatatgttgttacaaaaaaaaaaaaaaa

SEQ ID NO: 237 - protein, 361 aa, Glycine max
MKDRQRWRAEEDALLRAYVKQYGPREWNLVSQRMNTPLNRDAKSCLERWKNYLKPGIKKGSLTEEEQRLVINLQATHGNKWKKIAAQVPGRTAKRLGKWWEVFKEKQQRETKGNSCTIDPISDSKYEHILESFAEKLVKERPSTSTSTSFVMATSNSSFLHADAPAPAPALLPSWLSNSNGTAPVRPPSPSVTLSLSPSTVAAPPPWMQPPVRGQDNASPLVLGNVAPHGAVLAFGENMVMSELVECCKELDEVHHALAGHKKEAAWRLSRVELQLESEKAGRRREKMEEIEAKIKALREEQTAALDRIEAEYREQLAGLRRDAESKEQKLAEQWAAKHLRLTKFLEQVGCRSRLTEPNGR

SEQ ID NO: 238 - DNA, 1300 bp, Glycine max
tcttggaaatgaaagagaggcaacgttggagagctgaagaggatgctttattacgttcttatgtcaaacagtatggtcctagggaatggaatcttgtgtctcagcgcatgaacacatatcttaacagggatgctaagtcgtgcttggagaggtggaagaactacctcaagcctggcatcaaaaaaggctctcttactgaagaagagcagcgccttgtcatccaccttcaagcaaaatatggaaacaaatggaagaaaatcgctgctgaagtcccagggcgcactgctaagcggttaggcaagtggtgggaagtcttcaaagagaagcagcagagagagaaaaaggagatcaatagaattgccgacccaattaacaatagtaagtacgagcacatactcgagagttttgcagagaaactagttaaggaacgcccttcaccatcatttgtcatggctgcttccgatggggcatttctgctcactgatacaccagcacctgcatcttccttgcgtccttcttggctttccaattctagtagtgctgcagccatcggcccaagttccctttctgtgaaactaagtctttcttcctcaacggtggccacacctccattttcatggttgccacccgagagaggaccagacaatgctccttttgttttggggaatgtatcagcgcttcatggagctattccaactctaagtgatagcatgcatatgtctcagatggtggagcactgtaaagagttggaagaggggcatcgtgctttggccacgcacaagaaggaggcagcttggaggttaagtcgggtggagttacagttggagtcagagaaggccaaccgaagaagggagaagattgaagaatttgaagcaaagattaaagctcttcaggaagaggagaaagctgctttaggtagaattgaagcagaatacagagaacagttagctgcattgaggagagatgctgaaaacaaggagcaaaagttggcagaacaatgggatgcaaagcatttacggtttactaggttactagagcaattaggatgcagagcagggctccttgagccaaatgcaagatgaagatatattttggcaaaatggatattggtgctcttctgactaaaattatatgcagtttgtgatcttggtatatttttattttagacgtgtatgaatttcctatctattcatacaacttgagtaacttccgttaacagttgaattacctgcatatggtatcacatccgagtttataaacttagttatattcctgaaaaaaaaaaaaaaaaaaaaaaaaa

SEQ ID NO: 239 - protein, 357 aa, Glycine max
MKERQRWRAEEDALLRSYVKQYGPREWNLVSQRMNTYLNRDAKSCLERWKNYLKPGIKKGSLTEEEQRLVIHLQAKYGNKWKKIAAEVPGRTAKRLGKWWEVFKEKQQREKKEINRIADPINNSKYEHILESFAEKLVKERPSPSFVMAASDGAFLLTDTPAPASSLRPSWLSNSSSAAAIGPSSLSVKLSLSSSTVATPPFSWLPPERGPDNAPFVLGNVSALHGAIPTLSDSMHMSQMVEHCKELEEGHRALATHKKEAAWRLSRVELQLESEKANRRREKIEEFEAKIKALQEEEKAALGRIEAEYREQLAALRRDAENKEQKLAEQWDAKHLRFTRLLEQLGCRAGLLEPNAR

SEQ ID NO: 240 - DNA, 1437 bp, Gossypium hirsutum
atccatccccctttgtttgagagagagtttgtgtgttttggttgtttggactgtcggctttgattttatgttctccttaatcctttgctgttcttgtcggagattgtaagcttgaagatgcaaccaacacaaagtttaaatttgggcacttgaactcaaagaaaatatgatacattatgaggatcacagagcaatgggaagtggtgttttcccctggaaatgaaggagagacagcggtggagagctgaagaagacgctttgttgtgtgcatacgtaaaacaatatggtccgagggagtggaaccttgtgtcacaccgcatgaacacacccctgaacagggatgcaaaatcttgcttagagaggtggaataactatctcaaacctggtatcaagaagggatcccttacggaagaagagcaacgtcttgtaatccgtcttcaagctaaacacggcaacaaatggaagaaaattgcagctgaagtccctggtagaacagctaaaagactgggcaagtggtgggaggtattcaaggagaagcaacaaagggaacataaagagaagcataagacggttgagccagtcgaggaaggcaagtacgataggatattagaaacttttgctgaaaaactagtaaaacagggccatagctcagcctttcccatggctgcttctaacgggggttttcttcatactgacccaccttcacctgcaccaccaactttacttccaccttggctttctaattccagcaatgcgtccgttgtcacaccaccttccccttctgtgactttaagcttatctccctcaacggtggcagctgctcccccaatcccgtggctgcaacctgagaggatgtccgaaactagccctgttttgggaaacagggtgccccatggatcatttcctcgtagtgagaacctgctgatatctgaattgatggactgctgcagacagctggaagatgggcgccgcgcttgggttgcacatagaaaggaagcggcctggaggttaagaagggtagagttacaactcgaatcagaaaaggcttcccgtaaaaggaagaagatggaagaaatagagtcaaagatcgaggctctaagggaagagcagaagagtacacttgatagaatcgaagctgaatatagggaacaactggaggggctaagaagagatgcggaagcgaaggagcaaaaattagcggagcaatgggctgcaaagcatttgcatctgaccaagtttcttgaacaaacggggtgcagacccagggttgtggagcctaatgggcagtgagcaaagatgatttatcaagcgtctcctttcaacagactctgcattgtttttgatgatattctctactatagaagtctatttatagttggtttttctaggatgggacactctgaatgggaaaggtagcattagccctatctttgtgtt

SEQ ID NO: 241 - protein, 356 aa, Gossypium hirsutum
MKERQRWRAEEDALLCAYVKQYGPREWNLVSHRMNTPLNRDAKSCLERWNNYLKPGIKKGSLTEEEQRLVIRLQAKHGNKWKKIAAEVPGRTAKRLGKWWEVFKEKQQREHKEKHKTVEPVEEGKYDRILETFAEKLVKQGHSSAFPMAASNGGFLHTDPPSPAPPTLLPPWLSNSSNASVVTPPSPSVTLSLSPSTVAAAPPIPWLQPERMSETSPVLGNRVPHGSFPRSENLLISELMDCCRQLEDGRRAWVAHRKEAAWRLRRVELQLESEKASRKRKKMEEIESKIEALREEQKSTLDRIEAEYREQLEGLRRDAEAKEQKLAEQWAAKHLHLTKFLEQTGCRPRVVEPNGQ

SEQ ID NO: 242 - DNA, 1424 bp, Lotus corniculatus
gatttgctcttggaaatgaaggagaggcaacgttggacatctgaggaggatgctctattatgtgcttatgtcaaacagtatggtcctagagaatggcatctcgtgtctcagcgcatgaacacgactcttcacagggatgcaaagtcgtgtttagaaaggtggaagaactacctgaagcccggaatcaagaaaggatctctcacggaggaagagcagcgccttgtcatccgccttcaagcaaaacacggcaataagtggaagaaaattgctgcagaagtcccaggtcgaaccgctaagaggctaggcaagtggtgggaggtatttaaggagaaacagcagagagaaaaacaggagattagcaagtcaatcggcccggttgatgacagcaaatacgatcacattctcgagactttcgcggagaagctagtgaaagagcatccttcaccatcatatctcatggctgcttctaatggaccctttctccacactgacacacctgctgccacccctgcatcagctttgctccctccttggctttcaaattcgagcaacaatccagccacagctgggcagccaccttccccttccgtgacattaagcctctccccctcgacagtggcaggaccaccacctccatggagaggactggagaataatgctcttgctatggcgaacacagcgccccacggaactgttcctgctttcagcgataacatgctggtatctgagttagtggactgctgtaaggagttggaagaagtgcacggcgcgttggccgcacataagaaggaggcgacctggaggctgagaagggtggagctgcagttggagtcagagaaggcgaatagaaggagggagaagattgaagaaacggaagctaagattaaagctctcagggaacaacagaatgctgctttggaaagaattgaagcagagtatagagaacagttagctggattgaggagagatgcagaaaccaaagaacaaaagctggctgagcaatggactgtaaagcactcgcgccttatgaagtttatggagcagataggatgcagatcccggattgcagagactaatggaagatgaagacatcactcagaatcgatatctggttggggtgctgttctggcttgaatcatatatgcagtcactcacatattaagttttgatcttgtgcctaacctccagttttacaaatgtctgttattgcaacttgaggaatttgtattagaattagttgatgagttgcatccatctttatgaatatgaactgagttataagtttatgtagcttatttctgtcttatgttccatttccattgggatctcgaatgacatttgtacaaactgcaaagggatgttgttagcccggacttttagtttggaagtgttcttatgattaaaaaaaaaaaaaaaaaaaaaaa

SEQ ID NO: 243 - protein, 356 aa, Lotus corniculatus
MKERQRWTSEEDALLCAYVKQYGPREWHLVSQRMNTTLHRDAKSCLERWKNYLKPGIKKGSLTEEEQRLVIRLQAKHGNKWKKIAAEVPGRTAKRLGKWWEVFKEKQQREKQEISKSIGPVDDSKYDHILETFAEKLVKEHPSPSYLMAASNGPFLHTDTPAATPASALLPPWLSNSSNNPATAGQPPSPSVTLSLSPSTVAGPPPPWRGLENNALAMANTAPHGTVPAFSDNMLVSELVDCCKELEEVHGALAAHKKEATWRLRRVELQLESEKANRRREKIEETEAKIKALREQQNAALERIEAEYREQLAGLRRDAETKEQKLAEQWTVKHSRLMKFMEQIGCRSRIAETNGR

SEQ ID NO: 244 - DNA, 1218 bp, Lotus corniculatus
aatttgctcttggaaatgaaggagaggcaacgttggtcatctgaggaggatgctttactacatgcttatgtccaacaatatggtcctagggaatggaatctcgtgtctcagcgcatgaacacacctctcaatagggatacaaagtcatgcttagaaaggtggaagaactacctcaagcctggcattaaaaagggatctcttaccaaagaagagcagcgtcttgtgatcctccttcaagcaaattacggaaacaaatggaagaagatcgccgctgaagtccccggtcgcacggcgaagcgattagggaagtggtgggaagtctacaaagagaagcagcagagagaaaaaattgagatcaatgggatagttagcccaattagtgataccaagtatgaacatatgctagagggttttgctgagaaactagtgaaagagcacactttaccatcatttgctatggctgcatcatccaatgaggcatttctgcataccaattcatcagctatgcttccttcttggctttccaattatgattcaacttcaacacctccaagttctatttccgtgacgttgagcctttctccctcaacagtggcaacacctagaggactagagaacaatgctccttttgttttgaggaatgtaacagcacacaatggatctgttccttctttcagtgatcacattctcatgtcagaattggtgggattctccaaagagttggaagaggggcaccgcgctttggcggcacataagaaggaggcagagtggagactaagaaggttggagttgcagttggagtcggagaaggcgtgtcgaagaagggagaccgtggaagagtttgaggcgaatattaaagctcttcaagaagagcagacagctgctttgaatagaattgaaaatgcatgcagggaacagttaggtggattgaggagagatgctgagagcaaggagcaaaaattggcagagaaatggacttcaaagcatttgaggcttactaggttattagagcaaatgaaaatccagaccggggctccttgagccaaatgcaagatgaagatatgatcagcaaattggatataggtgctcttatgacttgaattatatgcactttatgttccttgttgtgatcctgatatatttattcacagatttgtgcaaatttcctatctattcatacaagtttgagtaaaaaaaaaaaaaaaaaaaaaaaaaaaa

SEQ ID NO: 245 - protein, 341 aa, Lotus corniculatus
MKERQRWSSEEDALLHAYVQQYGPREWNLVSQRMNTPLNRDTKSCLERWKNYLKPGIKKGSLTKEEQRLVILLQANYGNKWKKIAAEVPGRTAKRLGKWWEVYKEKQQREKIEINGIVSPISDTKYEHMLEGFAEKLVKEHTLPSFAMAASSNEAFLHTNSSAMLPSWLSNYDSTSTPPSSISVTLSLSPSTVATPRGLENNAPFVLRNVTAHNGSVPSFSDHILMSELVGFSKELEEGHRALAAHKKEAEWRLRRLELQLESEKACRRRETVEEFEANIKALQEEQTAALNRIENACREQLGGLRRDAESKEQKLAEKWTSKHLRLTRLLEQMKIQTGAP

SEQ ID NO: 246 - DNA, 1355 bp, Lycopersicon esculentum
aattcgattattttcttgaaatataataaaaaagatcatatgggtcgagctagaaactgggatgcctaagttgtttcttgaaaattatgaggagtttgggaggatggaaactggtgtttacacctggaaatgagggagaggcaacggtggcgagctgaagaggatgctttgttgcgggcatacgtgagacagtatggaccaaaagaatggccccttgtatcacagcgtatgaacacgccccttaacagggacgcgaagtcttgtttagaaaggtggaaaaactacctcaaaccagggattaaaaaaggatcactcactgaagacgagcagcgtcttgttatacaactacaagccaaacacggtaacaaatggaagaaaatagcagctgaagtaccaggtcgaactgctaaaagattaggaaagtggtgggaagttttcaaagagaagcaacagagagagcagaaagaaaacaacaaggttgttgatccagtagacgagggaaaatacgatcacattctcgaaacctttgcagaaaagattgtgaaagaaaggagtgtcccaggtttacttatggctacttctaatggaggtttcctccacgccgatgcctcaactcctacgccacaaactcttcttcctccgtggctttctaattcttctgctccttcaactgttagatcatcatctccatctgtgactttaagtctctccccctctactgtgccgcctacacctacacctggcattccgtggctacagacagatagaggacctgataatgcgcctctcatcttgagcagttttccacatcatagtgttgctccttgtggagaaaatccttttattactgaacttgcggaatgctgcaaggatttagacgaagggcatcgtacttggactgcacataagaaggaagcagcttggaggttaaggagggttgaattgcaactagaatctgaaaaagcaagcaaagttagggagaaaatggaggaaattgaagcaaaaatgaaagcgctgagggaagaacagaaagcaactctagacagaattgaagcagaatacaaggagcaactagcaggcttgaggagggatgcagaagcaaaagagcagaaattggcagagcaatggacatccaaacacatgcgccttgctaagtttcttgagcagatgggatgccaatcaagacttgctgaacctaatggcggccgctaaagcaaagcttgcaagctaagccaagaattcttttgtgtttccttgctcctttagacggttctttctacttgccgcgacttttcttactgtaaactttttgtttgatcatcttctatttggttttctaaatcactagtgaattc

SEQ ID NO: 247 - protein, 360 aa, Lycopersicon esculentum
MRERQRWRAEEDALLRAYVRQYGPKEWPLVSQRMNTPLNRDAKSCLERWKNYLKPGIKKGSLTEDEQRLVIQLQAKHGNKWKKIAAEVPGRTAKRLGKWWEVFKEKQQREQKENNKVVDPVDEGKYDHILETFAEKIVKERSVPGLLMATSNGGFLHADASTPTPQTLLPPWLSNSSAPSTVRSSSPSVTLSLSPSTVPPTPTPGIPWLQTDRGPDNAPLILSSFPHHSVAPCGENPFITELAECCKDLDEGHRTWTAHKKEAAWRLRRVELQLESEKASKVREKMEEIEAKMKALREEQKATLDRIEAEYKEQLAGLRRDAEAKEQKLAEQWTSKHMRLAKFLEQMGCQSRLAEPNGGR

SEQ ID NO: 248 - DNA, 1420 bp, Malus x domestica
agttttgggcggagatgcgtcgtggacgaaggttggttccgtcgtacacttaagcagatattaggagatcgactaatataatggcgtctggatcccagatacattatgaagagtttcggtttgaggcaatggacaattgtgcgtgctcctggagatgaaggagagacagcgttggagtgctgaagaggacgctttgttacgtgcatatgtgaagcaatatggaccaagggagtggaaccttgtatcgcagcgcatgaacacacccctagacagggatgctaaatcttgcttagaaaggtggaagaattatctcaaacccggtattaagaaaggatccctaactgaagaggagcagcgccttgtcatttgtcttcaagccaaacacggtaataagtggaagaaaattgctgctgaagtccctggtcgtacggctaagagattgggaaagtggtgggaagtgttcaaagagaagcagcaaagagaacagaagaacaagaagataactgaccctattgtggagggtaaatacgatacaatacttgaaacttttgccgagaagttggtgaaggagcgtgcgccaacctatctcatggctacttcaaacggggcctatcttcatacggaaacatcttctccagcgccaacgattcttcctccttggctttctaattccaatgtgtcccccaatgtgaggccaccatctccttctgttaccctgagtctgtccccgacagtggcaccctctccgccaatcccttggctgcagcaggatcgaggatcagatggtagttttgttgtgggaaatttgccacatcatggtgtagttcccgcttgtggggagaacctagtgatatctgagttggtggagtgctccagagagttggaggaaatgcaccgtgcttgggcagcgcataagaaggaagcttcgtggaggttaagaagggtggagttgcaactggattcggagaaggcttgtcggaggagggagaagatggaagagattgaagccaaggtgaaggctctaagggaagagcagaaggctgctctagacaggatcgaagcagaatacagggaacagttagcagggctaaggagggatgcagaagcaaaggagcagaagttggctgagcaatgggccgcgaagcatttgcgtctctcccagtttctcgagcagatgggaggcagaccaaggattgttgagcctaacggccggtgagaaatatgtgttttacatggtcattgtagacgcatgaggtccgaatttctatttctatttctgttttctgctttgtttcttttcttgcttttgatctcgtgtgcattctgatctgaaatgctgtcataggtgttttattacgtataccgtctggctattggcctggaccgaatgactgtattatcttttcgcaaaaaaaaaaaa

SEQ ID NO: 249 - protein, 353 aa, Malus x domestica
MKERQRWSAEEDALLRAYVKQYGPREWNLVSQRMNTPLDRDAKSCLERWKNYLKPGIKKGSLTEEEQRLVICLQAKHGNKWKKIAAEVPGRTAKRLGKWWEVFKEKQQREQKNKKITDPIVEGKYDTILETFAEKLVKERAPTYLMATSNGAYLHTETSSPAPTILPPWLSNSNVSPNVRPPSPSVTLSLSPTVAPSPPIPWLQQDRGSDGSFVVGNLPHHGVVPACGENLVISELVECSRELEEMHRAWAAHKKEASWRLRRVELQLDSEKACRRREKMEEIEAKVKALREEQKAALDRIEAEYREQLAGLRRDAEAKEQKLAEQWAAKHLRLSQFLEQMGGRPRIVEPNGR

SEQ ID NO: 250 - DNA, 1375 bp, Medicago truncatula
ccatttttcaacttcttcttcctgtttcatggacctgaatttcttaggttgttattagacatactcacactgtgactgagagacattatgaagattgcaagtttcaagaaaccggatgtcggatatgaaagataggcagcggtggagagcagaagaggatgcattattacgcgcttatgttaaacagtatggacctagagaatggaacctcgtgtctcagcgcatgaacacgcctcttaacagggacgcaaaatcgtgtttagaaaggtggaagaattacctcaagccaggtattaagaaaggatctctcaccgaagaagaacagcgtctagtcattagccttcaagcaacacacggaaacaaatggaagaaaattgccgcgcaagttcccggtcgaactgctaagaggttagggaagtggtgggaagtattcaaagagaaacaacaaagagaaacaaaaggtagtattaacagaactgtcgacccgattaacgatagcaagtacgaacacatactcgaaagttttgctgagaaactagtgaaagagagaccatctccttcatttgtcatggctgcttccaatagctcttatcttcataccgatgcacaagcaccaactccgggattgcttccttcatggctatcgaattcaaataatgcagcacctgttaggccaaattcaccatcagtgacactaagcctatctccctcgacagtagcagcgcctcctccgtggatgcaaccagtacgaggaccggacaacgctcctcttgttcttgggaacgtagctccacatggcgctgttctaagttacggcgaaagcatggtaatgtctgaattggttgattgctgcaaggagttggaagaagtgcatcatgcattggcagcgcacaagaaagaggcggcatggaggttaagccgagtggagctgcagttggagtcagagaaagcgagtcgaaggagggagaagatggaggaaatcgaagcgaagataaaagctttaagggaggaacaagctgttgctttggatagaattgaaggagaatatagggaacagttagcagggctgagaagagatgctgaaaccaaagagcagaaattgactgaacaatgggctgcgaagcatttacgccttaccaagtttctagaacaagtagggtgtagatcaaggcatgctgaatcaaatggaagatagatagaaagagagacagacatcactttcagcattttgatctagttaaggttttgtgtgattgagttttatgcagttttatggtccttgttagtttttgttctttgttcctatttgattaaaaaatgttcttatagatgcatattaatatcctatcttttcatacaacttgaggactttgca

SEQ ID NO: 251 - protein, 359 aa, Medicago truncatula
MSDMKDRQRWRAEEDALLRAYVKQYGPREWNLVSQRMNTPLNRDAKSCLERWKNYLKPGIKKGSLTEEEQRLVISLQATHGNKWKKIAAQVPGRTAKRLGKWWEVFKEKQQRETKGSINRTVDPINDSKYEHILESFAEKLVKERPSPSFVMAASNSSYLHTDAQAPTPGLLPSWLSNSNNAAPVRPNSPSVTLSLSPSTVAAPPPWMQPVRGPDNAPLVLGNVAPHGAVLSYGESMVMSELVDCCKELEEVHHALAAHKKEAAWRLSRVELQLESEKASRRREKMEEIEAKIKALREEQAVALDRIEGEYREQLAGLRRDAETKEQKLTEQWAAKHLRLTKFLEQVGCRSRHAESNGR

SEQ ID NO: 252 - DNA, 1333 bp, Morus alba
atgaaagagcgtcagcgttggcagcccgaagaagacgcactcctccgagcctacgtgaagcaatatggccccagggactggaacctcgtttaccagcgcatgggcaagcccctccaccgcgacccaaagtcctgcctcgagcggtggaagaactacctgaaacccggcctgaaaaagggttctctcacgccggaggagcaatccctcgtcatttctctccaagccaagtacggtaacaagtggaagaagatcgccgccgaggtccccggccgcacggccaagcgcctcggcaagtggtgggaggtcttcaaggagaagcagctcaagcagctccagctccagaagaaaccgccgtcgcagcccgacgggaatattccggtagccgtagcagtagccggaggatcttccccagcggataaggccgtacagggtccgtacgaccacatactggagacgttcgccgaaaagtacgtccaccaacagcggcctaacctaaaccccgcaattttacccgtcgtcccgtttccgatgcccaacccggatccggttctctcactcgggtcggttaattccactccgcctcccgcgcttcccccgtggatgaatttgaacgttaacgtcaacgcaacgacgtcgtcgctctcgtcctgcacaacgtcgtccagcgcgacgccgtctccctccgtcagcctctcgctctccccgtcagagccggtacagcagcagacgctcgaacaggagatgaaccggttcttgccggttcagcaaatggcgagcattttccagtgctgtaaggagctggaggaggggcggcagagctggttgcagcacaagaaggaggccacgtggcggccgagccggctggagcagcagctggagtcggagaagtcgaagaagaggaaagagaagatggaagagattgacgccaagatacggagcttgagagaagaggaaatggcgtttctcagtaggattgagggcgagtatagagaacagcttttggctttgcaaagagatgccgaggccaaggaggccaaactggttgaagcttggtgtggtaagcatgtgaagctggctaagctccttgaccagattggggcccaccattgttgtaatgccactaatggtttcaccgcttttcccaatccaaattagtgattttaagtgaaattaatgacaagaaaaaaacgttcgatgtgttgatccaacaaattagcattcaaaggtcgaatcttcgtagtacttgcgcactttttcgtgggtgttatggaagatgtgttatttgtgctgtgaatattgatgcttccttcgtttaaaaaaaaaaaaaaaaaaa

SEQ ID NO: 253 - protein, 384 aa, Morus alba
MKERQRWQPEEDALLRAYVKQYGPRDWNLVYQRMGKPLHRDPKSCLERWKNYLKPGLKKGSLTPEEQSLVISLQAKYGNKWKKIAAEVPGRTAKRLGKWWEVFKEKQLKQLQLQKKPPSQPDGNIPVAVAVAGGSSPADKAVQGPYDHILETFAEKYVHQQRPNLNPAILPVVPFPMPNPDPVLSLGSVNSTPPPALPPWMNLNVNVNATTSSLSSCTTSSSATPSPSVSLSLSPSEPVQQQTLEQEMNRFLPVQQMASIFQCCKELEEGRQSWLQHKKEATWRPSRLEQQLESEKSKKRKEKMEEIDAKIRSLREEEMAFLSRIEGEYREQLLALQRDAEAKEAKLVEAWCGKHVKLAKLLDQIGAHHCCNATNGFTAFPNPN

SEQ ID NO: 254 - DNA, 1704 bp, Nicotiana tabacum
ctcatcacattcccttaaacacgtcaccctccaaactactactattacagagaggaggggccataccattccataccttagcctttctctcttatagcttgctctcaccttcccctcttttctttatcttctgtcacttctctctcttcttctttcttctacccttttcctctttctttctttgcatacaacattcttcttcctctttctaattttttgctcatatttgctctgagaaaaacaaaacaatttaaaaaaaaaatcaaatgggtcgaggcaagaactgggcttcctaagtggtttcttgtaaattatgaggagtttgggaccatgggcactggtgtttgcacctggaaatgagggagaggcagcggtggcgatctgaagaggatgctttattgcgggcatatgtgaaacagtatggaccaaaagaatggcaccttgtatcacagcgtatgaacacagccctcaacagggacgctaagtcttgcttggaaaggtggaaaaactacctcaaaccagggattaagaaaggatcactcactcaagaggagcagcgtcttgttatccatctacaggccaaacacggcaacaaatggaagaaaatagcagctgaagtaccaggccgaactgctaaaagattggggaagtggtgggaagtattcaaagagaagcaacacagggagcagaaagaaaacaataaggttgtcgatccagtagacgagggaaaatacgaccacattcttgagacctttgcagagaagattgtgaaagagcggagtgtcccaggtttacttatggctacttctaatggaggtttcctccacgccgatgcaccagctccttcgccacaaactcttcttcctccgtggctttctaattccactgctacttcaaccgtcagatcaccatctccatctgtgactttaagtctatccccctcaacagtgcctcctacacctacgcctacgcctggcattccgtggctacagacagatagaggacctgaaaatgcgccccttattttgagcagttttccacatcatggggttgcccctccttgtggagaaaatccatttgttactgaacttgtggaatgctgtaaagagctagacgaagggcatcgtgcttgggctgctcataaaaaggaagcagcttggaggttaaggcgagtggaattgcagctagaatcagagaaaatatgcaaagttagggagaagatggaggaaattgaagcgaaaatgaaagctctgagggaagagcagaaggcaactctagacaggattgaagcagaatacaaggagcaactagcaggcttgaggagggacgcggaagcaaaggaacagaaattggccgaacaatgggcttccaaacacctgcgccttagtaagtttcttgagcagatgggatgccaatcaagacttgcagaacctaatggtggccgctaaagcaagctaagctaagaattcttttgtgtgtccctggccgcctaagacggttcttttcaaactgctacgacttttcttactgtaaactttttgtttgatcgccttttatttggttaactatgttttcttttctgcatgatactgcaacttgtatttctagtatctgcaaggatttcttgcagctttgcgacagcataatgaacctatatctttcagtagtaacatattaatagtattacttacacaaaaaaaaaaa

SEQ ID NO: 255 - protein, 363 aa, Nicotiana tabacum
MRERQRWRSEEDALLRAYVKQYGPKEWHLVSQRMNTALNRDAKSCLERWKNYLKPGIKKGSLTQEEQRLVIHLQAKHGNKWKKIAAEVPGRTAKRLGKWWEVFKEKQHREQKENNKVVDPVDEGKYDHILETFAEKIVKERSVPGLLMATSNGGFLHADAPAPSPQTLLPPWLSNSTATSTVRSPSPSVTLSLSPSTVPPTPTPTPGIPWLQTDRGPENAPLILSSFPHHGVAPPCGENPFVTELVECCKELDEGHRAWAAHKKEAAWRLRRVELQLESEKICKVREKMEEIEAKMKALREEQKATLDRIEAEYKEQLAGLRRDAEAKEQKLAEQWASKHLRLSKFLEQMGCQSRLAEPNGGR

SEQ ID NO: 256 - DNA, 1489 bp, Oryza sativa
ctcgctgctccttgtcccccacctcctttacttgagcttgctcaccactgcctccatatacagagagtcttctctgtatttctctctctcagtgggaggctcacaagaatctttcagctcacatctcactgtccttgcctttctctagctagggaggtccaagaacagagcagcaggatggtgcagtggcgtttctgagagcagcatgagtactcgcaccaccgagctgggatggtcggcgatggcgaacaccgatgcagccgccgccgatgagggagaggcagcggtggcggcctgaggaagacgccatcctcctcgcctacgtccgccagtatgggccccgggagtggagcctcgtgtcccagcggatgaaccgccccctccaccgcgacgccaagtcctgcctcgagcgctggaagaactacctccgcccggggatcaagaaaggttcgctcaccgacgacgagcagcgcctcgtcatccgcctccaggccaagcacggcaacaagtggaagaagatcgccgccgaggtccccggccggacggcgaagcggctgggcaagtggtgggaggtgttcaaggagaagcagcagcgggagctccgggatcgggatcgccggcgactcccgccgccgctggacggcgacgagcgcggctgcgccggcgggcgatacgactggctcctcgaggacttcgccgacaagctcgtcaacgaccaccaccgccgaatgatggctgccccgatcctcccgccgtggatgtcgtcgtcgccgtcgtcttcttcctcgccgtcggtgacgcttagcctcgcgtcggcggcggtggcgccggcgcctgcggcgccgccgccgacgtggggtggtggtggaggaggggaggtggtggtggcggagttgatggagtgttgcagggagatggaggaagggcagagggcgtgggcggcgcacaggaaggaggcggcgtggaggatgaagagggtggagatgcagctggagacggagagggcgtgccggcggcgggaggcgacggaggagttcgaggcgaagatgagggcgctgagggaggagcaggcagctgcggtggagcgggtggaggcggagtaccgggagaagatggccggcctccgccgcgacgcggaggccaaggagcagaagatggcggagcagtgggcggccaagcacgcccgcctcgccaagttcctcgaccaggtcgccgcctgccgccgctggccgcccgtagagatcaacggcggcggcggcggcggccccggcggcggccggtgagccgccggacggtggcgctgcatgcatgcgtagttggacacctcgctttcttgcttcttcttctcgtgtcctttttacaactgttggaattcacttctctctagaaatatgtaatcttttgagtctcttttgatcattccaagtttcctactagtagctctattgaataataaatggaccaccaaattgcaaaccaaaatggttac

SEQ ID NO: 257 - protein, 342 aa, Oryza sativa
MQPPPMRERQRWRPEEDAILLAYVRQYGPREWSLVSQRMNRPLHRDAKSCLERWKNYLRPGIKKGSLTDDEQRLVIRLQAKHGNKWKKIAAEVPGRTAKRLGKWWEVFKEKQQRELRDRDRRRLPPPLDGDERGCAGGRYDWLLEDFADKLVNDHHRRMMAAPILPPWMSSSPSSSSSPSVTLSLASAAVAPAPAAPPPTWGGGGGGEVVVAELMECCREMEEGQRAWAAHRKEAAWRMKRVEMQLETERACRRREATEEFEAKMRALREEQAAAVERVEAEYREKMAGLRRDAEAKEQKMAEQWAAKHARLAKFLDQVAACRRWPPVEINGGGGGGPGGGR

SEQ ID NO: 258 - DNA, 1506 bp, Pisum sativum
gtttttaagaacccatttcaacttcctctcttctgtttcatggaccagaattttttatcttcttcttaaaacactctgagagacattatgaagatttcaagttttgagaaaccggctgtgggatatgtccttggaaatgaaggataggcagcggtggagagcggaagaggatgcattactacgcgcttatgtcaaacagtatggtcctagggaatggaaccttgtgtctcagcgcatgaacacacctcttaaccgtgacgcaaagtcgtgtttagaacggtggaagaactacctcaagccgggtattaagaaaggatctttaactgaggaagagcagcaccttgtcattagtcttcaagcaacgcacgggaacaagtggaagaaaatcgctgcacaagttcccggtcgcactgctaagagattaggtaagtggtgggaagttttcaaagagaagcaacaaagagaaacaaaagggataaacaaaaccgtcgatccgatcaacgatagcaagtacgaacatatactcgaaagttttgcggagaagctagtgaaagagagaccttcaccttcatttgtcatggctgcttccaacagttcgtatcttcataccgacgcacaagcagcaacaccgggattgcttccttcatggctttcaaattccaacaatacagcacctgttaggccgaattctccttctgtgacattaagcctctctccctcgactgttgcagcacctcctccgtggatgcagcctgtacgaggaccggacaatgcgcctcttgttctcgggaacgtagctcctcacggcgctgttctatcttacggcgaaaacatggtgatgtctgagttaatagattgctgtaaggaattggaagaagggcatcacgcactggcagcgcacaagaaagaggcagcatggaggttaagccgagtggaactgcagttggagtcagagaaagcaagtcgaaggagggaaaagatggaggaaatcgaagcgaagataaaagctttgagggaggaacaagcggttgcgttggatagaattgaaggagaatatagagaacagttagcagggttgagaagagacgccgaggcgaaagagcagaaactggctgaacaatgggctgctaagcatttgcgccttacgaagtttctagaacaggtagggtgtagatcaaggcatgctgaacaaaatggaagatgaagagacagaaacatgattttcagcattgtgatctagttaaggttgtgtctttgtttatggtacttgttagttttgttcttgtccctatttggaagaaaatgttactatagatgcctattaatattcctatcttttcatacaatcttgagaactttgcatttgcattaggggttgatgcaatgcattgttatagttattacattcatctttatattcatatgccatagtatgtttatgtaatggtttttcattttggggtttcttttgtaataatcaactttatgagcaagatgtgtactact

SEQ ID NO: 259 - protein, 359 aa, Pisum sativum
MSLEMKDRQRWRAEEDALLRAYVKQYGPREWNLVSQRMNTPLNRDAKSCLERWKNYLKPGIKKGSLTEEEQHLVISLQATHGNKWKKIAAQVPGRTAKRLGKWWEVFKEKQQRETKGINKTVDPINDSKYEHILESFAEKLVKERPSPSFVMAASNSSYLHTDAQAATPGLLPSWLSNSNNTAPVRPNSPSVTLSLSPSTVAAPPPWMQPVRGPDNAPLVLGNVAPHGAVLSYGENMVMSELIDCCKELEEGHHALAAHKKEAAWRLSRVELQLESEKASRRREKMEEIEAKIKALREEQAVALDRIEGEYREQLAGLRRDAEAKEQKLAEQWAAKHLRLTKFLEQVGCRSRHAEQNGR

SEQ ID NO: 260 - DNA, 1264 bp, Solanum tuberosum
  misc_feature (1255)..(1255): n is a, c, g, or t
tcattttctcttttgctaaaacatattctccttctatcttttctctttttttactcttattttcttgaaatacaacaaaaaagaacatatgggtcgagctaaaaactgggatgcctaagttgttttttgaaaattatgaggagtttgggacgatggaaactggtgttgacacctggaaatgagggagaggcaacggtggcgagctgaagaggatgctttgttgcgagcatacgtgagacagtatggaccaaaagaatggcaccttgtatcacagcgtatgaacacaccccttaacagggacgcgaagtcttgtttagaaaggtggaaaaactatctcaaaccagggattaaaaaaggatcactcactgaagacgaacagcgtcttgttatccaattacaggctaaacatggtaacaaatggaagaaaatagcagctgaagtaccaggtcgaactgctaaaagactaggaaagtggtgggaagttttcaaagagaagcaacagagagagcagaaagaaaacaacaaggttgttgatccagtagacgagggaaaatacgatcacattctcgaaacctttgcagagaagattgtgaaagagcggagtgtcccaggattacttatggctacttctaatggaggtttcctccactctgatgcctcaactcctacgccacaaaatcttcttcctccgtggctttctaattcaactgctccttcaactgtcagatcatcatctccatctgtgactttaagtctctctccctcgacagtgccacctacaccaacgcctggcattccgtggctacagacagatagaggaccagataatgcatctctcatcttgagcagttttccacatcacggtgttgcacctccttgtggagaaaatccatttattactgaacttgcagaatgctgtaaggatttagacgaagggcatcgtacttggactgcacataagaaggaagcaacttggaggttaaggagggttgagttacaactagaatccgagaaagcaagcaaagttagggagaagatggaagaaattgaagcgaaaatgaaagctctgagggaagaacagaaagcaacactagacagaattgaagcagaatacaaggaccaactagcaggcttgaggagggatgcagaagcaaaagagcagaaattggcagagcaatggacatccaaacacatgcgccttgctaagtttcttgaacagatgggatgccaatctagacttgctgaacctaatggnggccgctaa

SEQ ID NO: 261 - protein, 361 aa, Solanum tuberosum
MRERQRWRAEEDALLRAYVRQYGPKEWHLVSQRMNTPLNRDAKSCLERWKNYLKPGIKKGSLTEDEQRLVIQLQAKHGNKWKKIAAEVPGRTAKRLGKWWEVFKEKQQREQKENNKVVDPVDEGKYDHILETFAEKIVKERSVPGLLMATSNGGFLHSDASTPTPQNLLPPWLSNSTAPSTVRSSSPSVTLSLSPSTVPPTPTPGIPWLQTDRGPDNASLILSSFPHHGVAPPCGENPFITELAECCKDLDEGHRTWTAHKKEATWRLRRVELQLESEKASKVREKMEEIEAKMKALREEQKATLDRIEAEYKDQLAGLRRDAEAKEQKLAEQWTSKHMRLAKFLEQMGCQSRLAEPNGGR

SEQ ID NO: 262 - DNA, 1077 bp, Vitis vinifera
atgaaggagaggcagcgttggagggctgaagaggacgctctattacgtgcttatgtgagacaatatggcccgagggaatggaaccttgtgtcacagcgtatgaacacgccccttgatagggatgccaaatcttgcctagaaaggtggaagaattacctcagacctggaatcaagaaaggatccctcactgaagaggagcaacgtcttgtaattcgtcttcaggccaaacacggcaacaaatggaagaaaattgcagctgaagtccctggacgtactgctaagagattggggaagtggtgggaagtgttcaaagagaagcagcagagagagcagaaagagaacaacaaggttgtggaccccattgaggagggcaagtacgatcggattctagagacttttgcagagaagttagtgaaagagcgtcctgccccagcatttctgatggctacttctaatggaaactttcttcatcctgatccacctgctcctcccccaccaactctacttcctccttggctttccaattccaactgcacctccactgttaggccaccctccccttctgtcaccttaagtctctgtccctcaacagttgcaacctcaccgacaattccatggctgcagccagagagagggccagacgccaccccgcttgttttgggcaacttgccaccccatggggcagtccccacgtctggagagaacttactgatttcagagctagtggagtgctgcagggagttggaagaagggcaccgagcttgggcagcacataagaaggaggcagcctggaggttaagaagggttgagctgcaactggaatcggagaaagcatgccgaaggagggaaaaaatggaagagatagaatcaaaggtgaaggctcttagggaagaacagaaggctacactggataggattgaggctgaatacagggaacagttagcaggactgaggagggatgcagaatccaaggagcagaagttggctgagcagtggagtgcaaagcacttgcgccttaccaaatttattgagcagatgggatgcagacccaggcttgccgagccaaatggccggtga

SEQ ID NO: 263 - protein, 358 aa, Vitis vinifera
MKERQRWRAEEDALLRAYVRQYGPREWNLVSQRMNTPLDRDAKSCLERWKNYLRPGIKKGSLTEEEQRLVIRLQAKHGNKWKKIAAEVPGRTAKRLGKWWEVFKEKQQREQKENNKVVDPIEEGKYDRILETFAEKLVKERPAPAFLMATSNGNFLHPDPPAPPPPTLLPPWLSNSNCTSTVRPPSPSVTLSLCPSTVATSPTIPWLQPERGPDATPLVLGNLPPHGAVPTSGENLLISELVECCRELEEGHRAWAAHKKEAAWRLRRVELQLESEKACRRREKMEEIESKVKALREEQKATLDRIEAEYREQLAGLRRDAESKEQKLAEQWSAKHLRLTKFIEQMGCRPRLAEPNGR

SEQ ID NO: 264 - DNA, 1420 bp, Zea mays
cgcgcattataaggtgtggtggtgagggatgggcgatggcctttgcagatgaaggagcgacagcgctggcggcctgaggaagacgccgtcctgcgcgcctacgtccggcagtacggcccccgcgagtggcacctggtgtcgcagcgcatgaacgtggccctcgaccgcgacgccaagtcgtgcctggagcgctggaagaactacctccgccccgggatcaagaagggctcgctcaccgaggaggagcagcgcctggtgatccgcctgcaggccaagcacggcaacaagtggaagaagatcgccgccgaggtgcccgggcgcacggccaagcgcctcggcaagtggtgggaggtgttcaaggagaagcagcagcgggagctgagggacagccgccgcccgccgccggagcctagccccgacgagcggggcaggtacgagtggctgctcgagaacttcgcggagaagctcgtcggagagaggccacagcaggctgccgctgcgccgtcgccgctgctcatggccgcgcccgtgctgccgccctggctgtcgtccaacgccgggccggccgccgccgccgccgccgccgtcgcgcacccgccgcccagaccgccgtcgccgtccgtgacgctcagcctcgcgtccgccgcggtggcgccgggcccgcccgcgcccgcgccatggatgccggatcgcgccgcggccgacgcggcgccgtacgggttcccgagcccgtcgcagcacggcggcgccgcgcccccgggcatggcggtcgtggacgggcaggcgctggcggagctcgccgagtgctgccgcgagctggaggaggggcggcgcgcgtgggcggcgcaccggcgggaggcggcgtggcggctgaagcgcgtggagcagcagctggagatggagcgcgagatgcggcggcgcgaggtgtgggaggagttcgaggccaagatgcgcaccatgcggctggagcaggcggccgccgcggagcgcgtggagcgggaccaccgggagaaggtggccgagctccgccgcgacgcgcaggtcaaggaggagaagatggccgagcagtgggccgccaagcacgcgcgcgtcgccaagttcgtcgagcagatgggggggtgctcccgttcatggtcctctgccaccgacatgaactgttgaactggacaaacgagccgctgaccacaccgtcgctagctatcgcgtgctacgtgctccggttcacggctttcttgcattctgggacgcgacttgtaaacgccatggattcccttgctcacgttcacttccgctttctttttttcttttctttttatttacaactgttgttacggtcggttcaatgcttctctctctatctactagtagttgatcagagtcaagaaatgtaatgctgccgttactgtcgtagtttcatcct

SEQ ID NO: 265 - protein, 370 aa, Zea mays
MKERQRWRPEEDAVLRAYVRQYGPREWHLVSQRMNVALDRDAKSCLERWKNYLRPGIKKGSLTEEEQRLVIRLQAKHGNKWKKIAAEVPGRTAKRLGKWWEVFKEKQQRELRDSRRPPPEPSPDERGRYEWLLENFAEKLVGERPQQAAAAPSPLLMAAPVLPPWLSSNAGPAAAAAAAVAHPPPRPPSPSVTLSLASAAVAPGPPAPAPWMPDRAAADAAPYGFPSPSQHGGAAPPGMAVVDGQALAELAECCRELEEGRRAWAAHRREAAWRLKRVEQQLEMEREMRRREVWEEFEAKMRTMRLEQAAAAERVERDHREKVAELRRDAQVKEEKMAEQWAAKHARVAKFVEQMGGCSRSWSSATDMNC

SEQ ID NO: 266 - DNA, 1266 bp, Hordeum vulgare
  misc_feature (881)..(881): n is a, c, g, or t
  misc_feature (991)..(991): n is a, c, g, or t
  misc_feature (1194)..(1194): n is a, c, g, or t
cagccaccctagtcactccgagctgagctgggcgaagagaagagaaagaatctttcggttgagatctcccccctcccttgcaataattttcggctgtctctctctcctgcaactgttgttgattcagagacgccaagaacagcgcaagaacagcatggtgtagtggtgcctctagtgcattatgaggtgtgaggagttgggatgggcgatggcctgtggtgcaggtgcagatggagatgaaggagagacagcggtggcggcctgaggaagacgccatcctccgctcctacgtccggcagtatggcccacgtgagtggaacctggtggcgcagcggatgaacgcgcccctcgaccgcgacgccaagtcctgcctcgagcgctggaagaactacctccgccccggcatcaagaaagggtccctcaccgacgacgagcagcggctcgtcatccgcctccaggccaagcacggcaacaagtggaagaagatcgccgccgaggtgcctggccggacggccaagcggcttggcaagtggtgggaggtgttcaaggagaagcagcagcgggagatcagggacagccggaggccgccgcccgagcccagccccgacgagaggggaaggtacgagtggctgctcgagaacttcgccgagaagcttgtcaaggagaggcagcagggtgggtgcgacgccgctgcaccaccacctcatggctgctcccatgctcccgccctggatgtcgtccaccgccaccaacggcgcgcccgtctcaaatgcgccgccgtcgccgtccgtcacgctcagcctcgcctccgccgtcgccgcgcccccgcccgcggcgccgtggatgcagcagcagcagcagatggtggaagacgggcgcgnccggttcgggttcgcaagcccgccgccggcgccgggcatgggggcggatggctcccaggcagcgctggcggaactggccgagtgctgcagggagctggacgaggggcacnatggctgggccgcgcaccggaagaggcatcttgaggctgaagcgcgggagctcaacttggatcggacccactgtcccgcgcggcaagtccccgaagaattaaggccaaatacggcgcttggggaggacacagcgccccttggacccctgaggcgaatccagaagaaggtgcgactccgcgatactagctagagcataaagtgnagatgggccccacccgccctacattactgagagtgtttttgtcgcgtgcccgaagaagacctggcgcgcgtt

SEQ ID NO: 267 - protein, 141 aa, Hordeum vulgare
MKERQRWRPEEDAILRSYVRQYGPREWNLVAQRMNAPLDRDAKSCLERWKNYLRPGIKKGSLTDDEQRLVIRLQAKHGNKWKKIAAEVPGRTAKRLGKWWEVFKEKQQREIRDSRRPPPEPSPDERGRYEWLLENFAEKLV

SEQ ID NO: 268 - protein, 117 aa, Artificial sequence
  IPR015495 MYB transcription factor
WRAEEDALLRAYVKQYGPREWNLVSQRMNTPLNRDAKSCLERWKNYLKPGIKKGSLTEEEQSLVIRLQAKHGNKWKKIAAEVPGRTAKRLGKWWEVFKEKQQRELKENNKTVEPIDE

SEQ ID NO: 269 - protein, 50 aa, Artificial sequence
  IPR014778 MYB DNA binding domain
RQRWRAEEDALLRAYVKQYGPREWNLVSQRMNTPLNRDAKSCLERWKNYL

SEQ ID NO: 270 - protein, 46 aa, Artificial sequence
  IPR014778 MYB DNA binding domain
KGSLTEEEQSLVIRLQAKHGNKWKKIAAEVPGRTAKRLGKWWEVFK

SEQ ID NO: 271 - protein, 107 aa, Artificial sequence
  C-terminal Conserved Domain (CD)
SELVDCCRELEEGHRAWAAHKKEAAWRLRRVELQLESERSCRRREKMEEIESKIKSLREEEKASLDRIEAEYREQLTGLRRDAETKEQKLSDQWTAKHLRLTKFLEQ

SEQ ID NO: 272 - DNA, 2194 bp, Oryza sativa; identical to SEQ ID NO: 218

SEQ ID NO: 273 - DNA, 53 bp, Artificial sequence
  primer: prm11884
ggggacaagtttgtacaaaaaagcaggcttaaacaatgaaggagaggcagcgt

SEQ ID NO: 274 - DNA, 50 bp, Artificial sequence
  primer: prm11885
ggggaccactttgtacaagaaagctgggtgacctgatacagctggacgta

SEQ ID NO: 275 - DNA, 345 bp, Solanum lycopersicum
atggagaagacacttagcttagtgctaatactccctcttctaataatgcttcttcttgttggaactcatgcaaaaataataatagaatctccagcacctcagccacaacctcctaacactttaccaatgaatggtactactcctggtagtctccatcctcaagattgtttaccaaagtgcacatatagatgctcaaatacacaatataggaagccatgtatgttcttttgccaaaaatgttgtgcaaagtgtctctgtgttcctgctgggacttatgggaacaaacaattttgcccttgttacaataattggaagactaagagaggaggcccaaaatgcccttaa

SEQ ID NO: 276 - protein, 114 aa, Solanum lycopersicum
MEKTLSLVLILPLLIMLLLVGTHAKIIIESPAPQPQPPNTLPMNGTTPGSLHPQDCLPKCTYRCSNTQYRKPCMFFCQKCCAKCLCVPAGTYGNKQFCPCYNNWKTKRGGPKCP

SEQ ID NO: 277 - protein, 9 aa, Artificial sequence
  Motif 4, comprising 4 conserved Cys residues
  UNSURE (2)..(3): Unknown amino acid
  UNSURE (6)..(7): Unknown amino acid
  UNSURE (9)..(9): Unknown amino acid
CXXCCXXCX

SEQ ID NO: 278 - protein, 8 aa, Artificial sequence
  Motif 5
  VARIANT (3)..(3): /replace = "Leu"
  VARIANT (4)..(4): /replace = "Lys" /replace = "Gln" /replace = "Ala" /replace = "Ser" /replace = "Thr"
  UNSURE (6)..(7): Unknown amino acid
  VARIANT (8)..(8): /replace = "Gly" /replace = "Ala" /replace = "Ser"
CVPPGXXQ

SEQ ID NO: 279 - protein, 5 aa, Artificial sequence
  Motif 6
  VARIANT (3)..(3): /replace = "Ala" /replace = "Thr" /replace = "Phe" /replace = "Arg" /replace = "Asn"
  UNSURE (4)..(4): Unknown amino acid
  VARIANT (5)..(5): /replace = "Leu" /replace = "Trp" /replace = "Lys"
CYDXM

SEQ ID NO: 280 - protein, 10 aa, Artificial sequence
  Motif 7
  VARIANT (1)..(1): /replace = "Leu" /replace = "Tyr" /replace = "Lys" /replace = "Ala"
  VARIANT (3)..(3): /replace = "Lys" /replace = "Met" /replace = "Ile" /replace = "Asn" /replace = "Leu"
  VARIANT (4)..(4): /replace = "Met" /replace = "Ile" /replace = "Val" /replace = "Thr" /replace = "Ser"
  UNSURE (7)..(8): Unknown amino acid
  VARIANT (10)..(10): /replace = "Gly" /replace = "Ala" /replace = "Lys" /replace = "Arg" /replace = "His" /replace = "Ser" /replace = Asp"
SCGLCCXXCN

SEQ ID NO: 281 - protein, 13 aa, Artificial sequence
  Motif 8
  VARIANT (4)..(4): /replace = "Ser" /replace = "Pro" /replace = "Ala" /replace = "Lys" /replace = "Gln"
  VARIANT (6)..(6): /replace = "Pro" /replace = "Thr"
  VARIANT (7)..(7): /replace = "Tyr" /replace = "Leu" /replace = "Ala" /replace = "Ser" /replace = "Phe"
  VARIANT (8)..(8): /replace = "Ala" /replace = "Gly" /replace = "Gln"
  VARIANT (9)..(9): /replace = "Ser" /replace = "Pro" /replace = "Asn" /replace = "Asp"
  VARIANT (10)..(10): /replace = "Lys" /replace = "Thr" /replace = "Tyr" /replace = "Leu" /replace = "Gln" /replace = "Glu"
  VARIANT (11)..(11): /replace = "Ser" /replace = "His" /replace = "Arg" /replace = "Glu" /replace = "Asn"
  UNSURE (12)..(12): Unknown amino acid
  VARIANT (13)..(13): /replace = "Ile"
CVPTGSGSTRDXC

SEQ ID NO: 282 - protein, 7 aa, Artificial sequence
  Motif 9
  VARIANT (1)..(1): /replace = "Arg" /replace = "Lys" /replace = "Thr"
  VARIANT (4)..(4): /replace = "Asp" /replace = "Thr" /replace = "Phe" /replace = "Ala"
  VARIANT (5)..(5): /replace = "Gln" /replace = "Arg" /replace = "Asn" /replace = "Ser" /replace = "Thr" /replace = "His" /replace = "Glu"
  VARIANT (6)..(6): /replace = "Lys" /replace = "Trp" /replace = "Leu"
  VARIANT (7)..(7): /replace = "Val" /replace = "Lys" /replace = "Arg" /replace = "Thr" /replace = "Asn" /replace = "Ile"
PCYRDML

SEQ ID NO: 283 - protein, 23 aa, Artificial sequence
  motif 10
  VARIANT (1)..(1): /replace = "Thr"
  VARIANT (2)..(2): /replace = "Pro" /replace = "Val" /replace = "Ala"
  VARIANT (4)..(4): /replace = "Asn" /replace = "MEt" /replace = "Ile"
  VARIANT (5)..(5): /replace = "Thr"
  VARIANT (6)..(6): /replace = "Phe" /replace = "Leu"
  VARIANT (8)..(8): /replace = "Leu" /replace = "Gln"
  VARIANT (9)..(9): /replace = "Tyr" /replace = "Lys"
  VARIANT (12)..(12): /replace = "Lys" /replace = "Glu" /replace = "Asn" /replace = "Ala" /replace = "Arg"
  VARIANT (13)..(13): /replace = "Arg" /replace = "Lys" /replace = "Thr" /replace = "Ser" /replace = "Ala"
  VARIANT (15)..(15): /replace = "Leu" /replace = "Arg"
  VARIANT (18)..(18): /replace = "Leu"
  VARIANT (19)..(19): /replace = "Ser" /replace = "Lys" /replace = "Ala"
  VARIANT (21)..(21): /replace = "Thr" /replace = "Val" /replace = "Asn" /replace = "Phe" /replace = "Leu"
  VARIANT (22)..(22): /replace = "Tyr" /replace = "Phe"
KRCLFYCNHCCGWCQCVPPGYVG

SEQ ID NO: 284 - protein, 14 aa, Artificial sequence
  Motif 11
  VARIANT (1)..(1): /replace = "His"
  VARIANT (3)..(3): /replace = "Asp" /replace = "Glu" /replace = "Gln" /replace = "Ala"
  VARIANT (4)..(4): /replace = "Glu" /replace = "Thr" /replace = "Ser" /replace = "Phe" /replace = "Ala" /replace = "Val"
  VARIANT (5)..(5): /replace = "Trp"
  VARIANT (6)..(6): /replace = "Pro"
  VARIANT (9)..(9): /replace = "Arg"
  VARIANT (10)..(10): /replace = "Asp"
  VARIANT (11)..(11): /replace = "Leu" /replace = "Met"
  VARIANT (12)..(12): /replace = "Thr" /replace = "Glu"
  VARIANT (13)..(13): /replace = "Lys" /replace = "Glu" /replace = "Asn"
  VARIANT (14)..(14): /replace = "Lus"
NKGCCSCYNNWKTQ

SEQ ID NO: 285 - protein, 8 aa, Artificial sequence
  Motif 12
  VARIANT (1)..(1): /replace = "Arg"
  VARIANT (2)..(2): /replace = "ys"
  VARIANT (3)..(3): /replace = "Lys"
  VARIANT (4)..(4): /replace = "Gln" /replace = "Ala" /replace = "Asn" /replace = "Lys" /replace = "Gly"
  VARIANT (5)..(5): /replace = "Thr"
  VARIANT (6)..(6): /replace = "Ser" /replace = "Gln" /replace = "Ala" /replace = "Lys"
  VARIANT (7)..(7): /replace = "Tyr" /replace = "Phe"
  VARIANT (8)..(8): /replace = "Thr" /replace = "Arg" /replace = "His"
NGSHKGHK

SEQ ID NO: 286 - DNA, 56 bp, Artificial sequence
  primer: prm10623
ggggacaagtttgtacaaaaaagcaggcttaaacaatggagaagacacttagctta

SEQ ID NO: 287 - DNA, 50 bp, Artificial sequence
  primer: prm10624
ggggaccactttgtacaagaaagctgggtatatatgattaagggcatttt

SEQ ID NO: 288 - DNA, 56 bp, Artificial sequence
  primer: prm10625
ggggacaagtttgtacaaaaaagcaggcttaaacaatgaagaagctcttctttgct

SEQ ID NO: 289 - DNA, 50 bp, Artificial sequence
  primer: prm10626
ggggaccactttgtacaagaaagctgggtacatgcacatcttgactgtct

SEQ ID NO: 290 - DNA, 2194 bp, Oryza sativa; identical to SEQ ID NO: 218

SEQ ID NO: 291 - protein, 89 aa, Populus thrichocarpa
MKKLFFVTLLLCSLLFSSSFLEPVMTKSSFCAKKCDTRCANAGIQDRCLKYCGICCEQCKCVPSGTYGNKHECPCYRDKRNSKGKPKCP

SEQ ID NO: 292 - protein, 112 aa, Medicago truncatula
MERKITLLILMVALLFCMTKVLCADSSVHIQDQFTHFEVVKGPNRRLLAFVDCGTRCNVRCSVHSRPNVCMRACGTCCLRCKCVPPGTYGNREMCGRCYTDMITRGNKPKCP

SEQ ID NO: 293 - protein, 106 aa, Arabidopsis thaliana
MMKLIVVFVISSLLFATQFSNGDELESQAQAPAIHKNGGEGSLKPEECPKACEYRCSATSHRKPCLFFCNKCCNKCLCVPSGTYGHKEECPCYNNWTTKEGGPKCP

SEQ ID NO: 294 - protein, 97 aa, Arabidopsis thaliana
MANCIRRNALFFLTLLFLLSVSNLVQAARGGGKLKPQQCNSKCSFRCSATSHKKPCMFFCLKCCKKCLCVPPGTFGNKQTCPCYNNWKTKEGRPKCP

SEQ ID NO: 295 - protein, 106 aa, Arabidopsis thaliana
MAKSYGAIFLLTLIVLFMLQTMVMASSGSNVKWSQKRYGPGSLKRTQCPSECDRRCKKTQYHKACITFCNKCCRKCLCVPPGYYGNKQVCSCYNNWKTQEGGPKCP

SEQ ID NO: 296 - protein, 101 aa, Arabidopsis thaliana
MAKLITSFLLLTILFTFVCLTMSKEAEYHPESYGPGSLKSYQCGGQCTRRCSNTKYHKPCMFFCQKCCAKCLCVPPGTYGNKQVCPCYNNWKTQQGGPKCP

SEQ ID NO: 297 - protein, 78 aa, Allium cepa
MLVESAKNGYGQGSLRSYQCSGQCARRCSKTQYRKPCLFFCNKCCAKCLCVPPGFYGNKGVCPCYNNWKTQQGGPKCP

SEQ ID NO: 298 - protein, 119 aa, Allium cepa
MANSTCILLLSLHLLLIIATAIQVKHAHAPTLQPVNSTAPTAQPNYPSHGFTEGSLQPQECGGRCDVRCSATQYRKPCMFFCQKCCATCRCVPSGTYGNKQTCPCYNNWKTKRGGPKCP

SEQ ID NO: 299 - protein, 118 aa, Allium cepa
MQSSAFSTVMPRSSDSLGTRGAKLYLGVTPLGRPKLDKITLAPLLIKYLIVGTAARILVSSVIFWLSSRGTFKSALTNTFFPFNSAALKSPTLLLAMETTPLGPLVRCVEKARALDET

SEQ ID NO: 300 - protein, 152 aa, Oryza sativa
MEGVGVGVRIRALLCCIAMAAMLLSSYQQGQAEASYMPWPPATPPPPAAAAANSTSTAAANNSSSSSSTTAPPQQPTAFPMYGVTPGSLRPQECGGRCAYRCSATAYRKPCMFFCQKCCASCLCVLPGTYGNKQSCPCYNDWKTKRGGPKCP

SEQ ID NO: 301 - protein, 105 aa, Oryza sativa
MAPGKLAVFALLASLLLLNTIKAADYPPAPPLGPPPHKIVDPGKDCVGACDARCSEHSHKKRCSRSCLTCCSACRCVPAGTAGNRETCGRCYTDWVSHNNMTKCP

SEQ ID NO: 302 - protein, 117 aa, Oryza sativa
MDPASRSLSIIFFLVAVTFVVEVSGQKNEAVYHLFGGEGSLTKNECPGKCSYRCSATSHTTVCMTYCNYCCERCLCVPSGTYGNKEECPCYNNMKTQEGKPNVCELGIEEKRNDTGE

SEQ ID NO: 303 - protein, 117 aa, Oryza sativa
MDTLHNTPTLKLLAWSLGPAFTSTMKLNTTTTLALLLLLLLASSSLQVSMAGSDFCDGKCKVRCSKASRHDDCLKYCGVCCASCNCVPSGTAGNKDECPCYRDMTTGHGARKRPKCP

SEQ ID NO: 304 - protein, 92 aa, Oryza sativa
MASMAKSLLCISLVAILLLVETTAPHGQAYAIDCGAKCGYRCSKSGRPKMCLRACGTCCQRCGCVPPGTSGNENVCPCYANMTTHNGRHKCP

SEQ ID NO: 305 - protein, 117 aa, Oryza sativa
WSFREMALAGRLLVLFAIALLAISIAEHKALAKGSTSEHDDNVYQVSKGGQGSLKSYQCSPQCAYRCSQTQYKKPCLFFCNKCCNACLCVPSGLYGNKGECPCYNNWKTKRGGPKCP

SEQ ID NO: 306 - protein, 94 aa, Oryza sativa
MKTRRAALLMLLLLVVVAAASWPQPCDAASGFCGSKCAVRCGRGRGRGSGCLRSCGLCCEECNCVPTGSGSTRDECPCYRDMLTAGPRKRPKCP

SEQ ID NO: 307 - protein, 102 aa, Oryza sativa
MRVPPLRATTALLATLLVAASFQDLTVAADGGGGVVPVPDSVCDAKCQKRCSLKVAGRCMGLCKMCCHDCGGCVPSGPYASKDECPCYRDMVSPKSRRPKCP

SEQ ID NO: 308 - protein, 92 aa, Oryza sativa
MASMAKSLLCISLVAILLLVETTAPHGQAYAIDCGAKCGYRCSKSGRPKMCLRACGTCCQCCGCVPPGTSGNENVCPCYANMTTHNGRHKCP

SEQ ID NO: 309 - protein, 84 aa, Oryza sativa
MAGGRGRGGGGGGGVAGGGNLRPWECSPKCAGRCSNTQYKKACLTFCNKCCAKCLCVPPGTYGNKGACPCYNNWKTKEGGPKCP

SEQ ID NO: 310 - protein, 93 aa, Oryza sativa
MKLNTTTTLALLLLLLLASSSLQVSMAGSDFCDGKCKVRCSKASRHDDCLKYCGVCCASCNCVPSGTAGNKDECPCYRDMTTGHGARKRPKCP

SEQ ID NO: 311 - protein, 102 aa, Populus trichocarpa
MKLSFAALLLLSVVLLSSFLRFTMAVPNHVASPPPPSPAIPSFCDPKCKARCAKAGYYQRCYDYCIICCKDCKCVPSGTYGNKSECPCYRDKLNSKGTSKCP

SEQ ID NO: 312 - protein, 101 aa, Populus trichocarpa
MAISKLLIASLLVSLLVLHLAEADQKVNSNQAASHVPGNNIDCGGACHARCSLSSRPRLCKRACGSCCARCKCVPQGTSGNLDTCPCYATLTTRGGRRKCP

SEQ ID NO: 313 - protein, 121 aa, Populus trichocarpa
  misc_feature (37)..(54): Xaa can be any naturally occurring amino acid
MDPETALELVKQGATLLLLDVPQYTLVGIDTQVLEIXXXXXXXXXXXXXXXXXXEATSLISPASTRCNYRCSATSHKKPCMFFCLKCCATCLCVPPGTYGNKETCPCYNNWKTKEGRPKCP

SEQ ID NO: 314 - protein, 39 aa, Populus trichocarpa
YCGICCEQCKCVPSGTYGNKHECPCYRDKRNSKGKPKCP

SEQ ID NO: 315 - protein, 100 aa, Populus trichocarpa
MSRKPSINANITEAPTPQPQPNTNSNRPPYGTTQGSLNPQECGPRCTGRCSKTAFKKPCMFFCQKCCAKCLCVPAGTYGNKQSCPCYNNWKTKRGGPKCP

SEQ ID NO: 316 - protein, 107 aa, Populus trichocarpa
MAKFVAVFLLALIAISMLQTLVVASHGRGGHHNNNKNKYGPGSLKSFQCPSQCTRRCSKTQYHKPCMFFCQKCCKKCLCVPPGYYGNKAVCPCYNNWKTKEGGPKCP

SEQ ID NO: 317 - protein, 95 aa, Populus trichocarpa
MAISKLLIASLVVSLLVLQQVNASPAAGSIPGKNIDCGGACKDRCSLSSRPHLCNRACGTCCARCKCVPKGTSGNLDTCPCYATMTTHGGRRKCP

SEQ ID NO: 318 - protein, 87 aa, Populus trichocarpa
MQAPSLFVFIYLVLEILIMLVISCGVAFCTKKCNTRCANAGIQDRCLKYCGICCEQCKCVPSGTYGNKHECPCYRDKRNSKGKPKCP

SEQ ID NO: 319 - protein, 113 aa, Populus trichocarpa
MGKSSIAIFLCSLLVLVLLGQNQALKTPISASQTQRQGNHAMYGATQGSLRPQECAPRCTTRCSATAYKKPCLFFCQKCCAKCLCVPPGTYGNKQSCPCYNNWKTKRGGPKCP

SEQ ID NO: 320 - protein, 245 aa, Populus trichocarpa
MAFKAVCLMVVAFVLVTAKASYMNEDFKEKAVFSKSVVPASTPAPPEVKSPTPAPPVVTPSTPLYKPPTPAPPVKTPPPAPPVNPPTPVKPPTTPAPPVYKPPSPAPPVNPPTPVKPPTTPAPPVYKPPSPAPPVNPPTPVPPVKPPTAPAPPVYKPPSPAPTPVPPVKPPTTGPMPPPVRTRSDCTPLCGQRCKLHSRKRLCVRACMTCCDRCKCVPPGTYGNREKCGKCYTDMTTRRNKPKCP

SEQ ID NO: 321 - protein, 66 aa, Populus trichocarpa
MDSIRYCGGLCKQRCSLHSRPNLCNRACGTCCVRCKCVPPGTSGNREVCGTCYTDMTTHGNKTKCP

SEQ ID NO: 322 - protein, 88 aa, Populus trichocarpa
MKPVFAAIFLLCLVFSSSLFEVTMAASGFCDSKCSVRCSKAGIKDRCLKYCGICCEKCKCVPSGTYGNKHECPCYRDMKNSKGKPKCP

SEQ ID NO: 323 - protein, 91 aa, Populus trichocarpa
MVSAKTTFILAILCLALMHELQIRTVEAGKINCKSKCEYRCSKASRHKMCIRACNTCCQRCNCVPPGTSGNEDTCPCYANMTTHGGRHKCP

SEQ ID NO: 324 - protein, 93 aa, Populus trichocarpa
MAVRSLLALMVFVFCLAELVVRGGNRRLMQDIDCGGLCKQRCSLHSRPNVCTRACGTCCVRCKCVPPGTSGNREVCGTCYTDMTTHGNKTKCP

SEQ ID NO: 325 - protein, 95 aa, Populus trichocarpa
MASLSRNSLLVVLSLCLLITFSNVAEIHGAKLRPSECKPRCNYRCSATSHKKPCMFFCLKCCATCLCVPPGTYGNKETCPCYNNWKTKEGRPKCP

SEQ ID NO: 326 - protein, 68 aa, Populus trichocarpa
MLIWFRFSDCGSACKARCQLSSRPRLCKRACGTCCSRCSCVPPGTAGNYEACPCYASLTTHGGRRKCP

SEQ ID NO: 327 - protein, 87 aa, Populus trichocarpa
MQITFWMQMDEESDVVAIDKKHYPKRINCGYLCARRCRASSRKNVCHRACKTCCNRCRCVPPGTYGNKSACPCYASLRTHGNKPKCP

SEQ ID NO: 328 - protein, 65 aa, Solanum_lycopersicum
MAGSYFCDSKCKLRCSKAGLADRCLKYCGICCEECKCVPSGTYGNKHECPCYRDKKNSKGKSKCP

SEQ ID NO: 329 - protein, 146 aa, Solanum_lycopersicum
MAMALRVLLLLVLFFLTVKAQDSIIDLKEVEEDKQQHVGLSQALRVFTRGANRRLVQDIVLKVAKYLNNGDIALAPAPAPPPSPLDCGGLCKYRCSLHSRPNVCFRACGTCCVRCKCVPPGTFGNREKCGKCYTEMTTHGNKTKCP

SEQ ID NO: 330 - protein, 104 aa, Solanum_lycopersicum
MAISKALFASLLLSLLLLEQVQSIQTDQVSSNAISEGADSYKKIDCGGACAARCRLSSRPRLCHRACGTCCARCNCVPPGTSGNTETCPCYASLTTHGNKRKCP

SEQ ID NO: 331 - protein, 81 aa, Solanum_lycopersicum
MFLILLTFSNVVEGYNKLRPTDCKPRCTYRCSATSHKKPCMFFCQKCCATCLCVPKGVYGNKQSCPCYNNWKTQEGKPKCP

SEQ ID NO: 332 - protein, 112 aa, Solanum_lycopersicum
MAGKMSIVLFVLLVVFLTQNQVSRANIMRDEQQQQQRNNQLYGVSEGRLHPQDCQPKCTYRCSKTSYKKPCMFFCQKCCAKCLCVPAGTYGNKQSCPCYNNWKTKRGGPKCP

SEQ ID NO: 333 - protein, 112 aa, Solanum_lycopersicum
MAISKFLLVTMVLISLLVFRPVEANGNGDGDNLAVHTAGPEGANNPTYIPTSECGTACEARCSLASRHKMCLRACGTCCTRCNCVPPGTSGNQDLCPCYRDMLTHHGKHKCP

SEQ ID NO: 334 - protein, 96 aa, Solanum_lycopersicum
MAKSGYNASFLLLISMFLILLTFSNVVEGYNKLRPTDCKPRCTYRCSATSHKKPCMFFCQKCCATCLCVPKGVYGNKQSCPCYNNWKTQEGKPKCP

SEQ ID NO: 335 - protein, 102 aa, Solanum_lycopersicum
MTVQKAFVAMLIASFLLVHFANAQKVDYSKPPASAPQGPQPLDCIGACKYRCSESSRQNLCNRACGSCCHRCHCVPPGTSGNYESCPCYFNLTTHNTTRKCP

SEQ ID NO: 336 - protein, 104 aa, Solanum_lycopersicum
MAKIVSVLLLALLVISMLANTVMAANGKHHHYAKKYGPGSLKPSQCLPQCTRRCSKTQYHKPCMFFCQKCCNKCLCVPPGTYGNKAVCPCYNNWKTKEGGPKCP

SEQ ID NO: 337 - protein, 72 aa, Solanum_lycopersicum
MVLVRGRPPSSRLSTKMHRTRCSKTSYKKPCMFFCQKCCAKCLCVPAGTYGNKQSCPCYNNWKTKRGGPKCP

SEQ ID NO: 338 - protein, 114 aa, Solanum_lycopersicum; identical to SEQ ID NO: 276

SEQ ID NO: 339 - protein, 103 aa, Solanum_lycopersicum
MASLKGFAALLIASLVLVHFTYALQEVISGKPPAPSPQPPKPIDCTGSCKTRCSKSSRQNLCNRACGSCCRTCHCVPPGTSGNYEACPCYFNLTTHNSTRKCP

SEQ ID NO: 340 - protein, 103 aa, Solanum_lycopersicum
MKIFTLFLIFILLIQVFANAATEQIEAGNEGALHKKIHPIKRIHCGYACARRCKKSSRKKVCMRACKTCCARCKCVPPGTYGNKEVCPCYARLRTHGNKPKCP

SEQ ID NO: 341 - protein, 94 aa, Solanum_lycopersicum
MRLLHIFLALLIMASMSRAQPPVGPTTCPVPKDKCEEACNVRCSQKGHKKRCLFYCNHCCGWCQCVPPGYVGENKDCCPCYRDWKKQTGEPKCP

SEQ ID NO: 342 - protein, 56 aa, Solanum_lycopersicum
MDINGSHKGHKKRCLFYCNHCCGWCQCVPPGYVGQNKGCCSCYNNWKTQIGGPKCP

SEQ ID NO: 343 - protein, 116 aa, Triticum_aestivum
  misc_feature (63)..(63): Xaa can be any naturally occurring amino acid
  misc_feature (93)..(93): Xaa can be any naturally occurring amino acid
  misc_feature (103)..(103): Xaa can be any naturally occurring amino acid
MAKISFLLVALLVLAVAFPVEVMGGGNGGAGGGGKLKPWECSSKCSSRCSGTQYKKACLTYCXKCCATCLCVPPGNYGNKGAWPCYNNWEEQXREGPKCPRIXEFPSSSSGGATCG

SEQ ID NO: 344 - protein, 201 aa, Triticum_aestivum
  misc_feature (7)..(8): Xaa can be any naturally occurring amino acid
  misc_feature (13)..(13): Xaa can be any naturally occurring amino acid
  misc_feature (17)..(17): Xaa can be any naturally occurring amino acid
  misc_feature (25)..(26): Xaa can be any naturally occurring amino acid
MYVGFNXXWRFTXNDKXHIINVKAXXCHICSNQNKELPAPKSSNDDFTLSLCDISMQGTGSRNQTRELRCIFTSPQPNKRLLLPNISWTKLKKRRTAMKPLPVTLALLALFLAASYQDLAVAAADADADGVGSGAPVLDSVCEGKCKNRCSQKVAGRCMGLCMMCCGKCAGCVPSGPLAPKDECPCYRDMKSPKSGRPKCP

SEQ ID NO: 345 - protein, 92 aa, Triticum_aestivum
MAGQARAFMCVALVVLLLLVETTAPSGQAHAVDCGSACSYRCSKSSRPNLCNRACNTCCRRCDCVPPGTAGNEDVCPCYAHMTTHDGRHKCP

SEQ ID NO: 346 - protein, 103 aa, Triticum_aestivum
MACVARTLSIPFLLALFFVAEVSGSMNVESYKPAGAEGSVPLKECPAKCKIRCSATSHKKPCNFYCNYCCKRCLCVPSGTVGNKEECPCYNNLKTQDGKPKCP

SEQ ID NO: 347 - protein, 94 aa, Triticum_aestivum
MKLGPTATTVALLLVLLLASSSLRAATAGSAFCDGKCGVRCSKASRHDDCLKYCGICCAECNCVPSGTAGNKDECPCYRDKTTGHGARKRPKCP

SEQ ID NO: 348 - protein, 114 aa, Triticum_aestivum
MVTKVICFLVLASVLLAVAFPVSALRQQVKKGGGGEGGGGGSVSGSGGGNLNPWECSPKCGSRCSKTQYRKACLTLCNKCCAKCLCVPPGFYGNKGACPCYNNWENKEGGPKCP

SEQ ID NO: 349 - protein, 101 aa, Triticum_aestivum
MAKISFLLVALLVLAVGFPVEVMGGGGGGGGGGGGGNLKPWECSSKCSSRCSGTQYKKACLTYCNKCCATCLCVPPGTYGNKGACPCYNNWKTKEGGPKCP

SEQ ID NO: 350 - protein, 94 aa, Triticum_aestivum
MKLGPTATTVALLLVLLLASSSLRAATGGSAFCDGKCGVRCSKASRHDDCLKYCGICCAECNCVPSGTAGNKDECPCYRDKTTGHGARKRPKCP

SEQ ID NO: 351 - protein, 113 aa, Triticum_aestivum
  misc_feature (80)..(80): Xaa can be any naturally occurring amino acid
  misc_feature (102)..(102): Xaa can be any naturally occurring amino acid
MKKLRTTTLALLLLLVFLAASSLRAAMAGSAFCDGKCGVRCSKASRHDDCLKYCGICCAECNCVPSGTAGNKDECPCYRXKNNGQGARKEGQVPKIRQQSPXIDSPTPMGSKQ

SEQ ID NO: 352 - protein, 128 aa, Triticum_aestivum
  misc_feature (116)..(116): Xaa can be any naturally occurring amino acid
MKKLRTTTLALLLLLVFLAASSLRAAMAGSAFCDGKCGVRCSKAGRHDDCLKYCGICCAECNCVPSGTAGNKDECPCYRDKNNGHGARKEGQMPMIRQHSPSIDSPTAMGSKKHIXLKLHATLSNQVL

SEQ ID NO: 353 - protein, 94 aa, Triticum_aestivum
  misc_feature (26)..(28): Xaa can be any naturally occurring amino acid
MAKISFLFVALLVLAVAFPVKVMGVXXXGKLKPWECPSKCSSRCSGTQYKKACLTYCNKCCATCLCVPPGTYGNKGACPCYNNWKTKEGGPKCP

SEQ ID NO: 354 - protein, 98 aa, Triticum_aestivum
MKKLRTTTATTTLALILLLVLIAATSLRVAMAGSAFCDSKCGVRCSKTGRHDDCLKYCGICCAECNCVPSGTAGNKDECPCYRDKTTGHGARTRPKCP

SEQ ID NO: 355 - protein, 92 aa, Triticum_aestivum
MAGKARVFMCVALVVLLLLVETTAPSGQAHAVDCGSACSYRCSKSSRPNLCNRACNTCCRRCDCVPPGTAGNEDVCPCYAHMTTHDGRHKCP

SEQ ID NO: 356 - protein, 107 aa, Triticum_aestivum
MKPLPVTLALLALFLVASYQDLTVAADADADAAGAGDVGAVPVPDSVCEGKCKNRCSQKVAGRCMGLCMMCCGKCAGCVPSGPLAPKDECPCYRDMKSPKSGRPKCP

SEQ ID NO: 357 - protein, 117 aa, Triticum_aestivum
MAPGKQLLPPLLLLMLLHHQPAAGASDPPVTHGGMRASTARSLLQQQQQQQPPRLDCPKVCLGRCANNWRNEMCNDKCNVCCQRCNCVPPGTGQDTRHICPCYDRMTNPHNGKLKCP

SEQ ID NO: 358 - protein, 98 aa, Triticum_aestivum
MKKLHTTTATTTLALLLLLVLLAATSLRVAMAGSAFCDSKCGVRCSKASRHDDCLKYCGICCAECNCVPSGTAGNKDECPCYRDKTTGHGARTRPKCP

SEQ ID NO: 359 - protein, 99 aa, Triticum_aestivum
MAKISFLLVALLVLAVAFPVEVMGGGNGGAGGGGKLKPWECSSKCSSRCSGTQYKKACLTYCNKCCATCLCVPPGTYGNKGACPCYNNWKTKEGGPKCP

SEQ ID NO: 360 - protein, 129 aa, Triticum_aestivum
MAPTQQRLLTRRRLLPPLLLLLLLAAHLQPAAASSSASDPLVTTTTAHGSMRASSRSLLQQQPPPRLDCPKVCLGRCANNWKNEMCNDKCNVCCQRCNCVPPGTGQDTRHICPCYDQMTNPHNGKLKCP

SEQ ID NO: 361 - DNA, 270 bp, Populus thrichocarpa
atgaagaagctcttctttgttactttgctgttgtgttcactcctcttcagctcgtctttcttggaacctgtcatgactaagtcatctttctgtgccaagaagtgcgatacgaggtgcgcaaacgctggcatacaggataggtgcttgaagtactgtggaatatgctgcgaacagtgcaagtgtgtgccctctggaacttatgggaacaagcatgagtgcccttgttacagggacaagaggaactccaagggcaagcccaagtgtccttaa

SEQ ID NO: 362 - DNA, 569 bp, Medicago truncatula
atggagaggaaaataacattgctgattttgatggttgcattgctcttctgcatgactaaggtattatgtgctgattctagtgtccacattcaagaccaatttactcattttgaggtggtaaaaggacctaatagaaggcttttggcatttgtggattgtggaacaaggtgcaatgtgaggtgcagtgtgcattcaagaccaaatgtttgtatgagagcttgtggaacatgttgtttaaggtgcaagtgtgttcctccaggcacttacggcaacagagaaatgtgtgggaggtgttacactgatatgattacacgtggcaacaagcccaagtgcccctaattcaacttgtccaagcttaaattagaattccccttatgtttttttgtctttattttgtttctagcattatgtatgagtttgtctattaatttgtgagttagttatccttaatgagtaagacgtggaataaacaactacattttttgcttaatgagtttgtgtatcagatgaaaatatataatcactattagttgtattttgtgattatttattacgagaaacaattgatt

SEQ ID NO: 363 - DNA, 321 bp, Arabidopsis thaliana
atgatgaagctcatagttgtctttgttatatccagtttgttgtttgctactcaattttctaatggtgatgaattagagagtcaagctcaagcacctgcaatccataagaatggaggagaaggctcacttaaaccagaagaatgtccaaaggcatgtgaatatcgatgttcggcgacatctcacaggaaaccatgtttgtttttttgcaacaaatgttgtaacaaatgtttgtgtgtaccatcgggaacatatggacacaaagaagaatgtccttgctacaataattggacgaccaaagaaggtggaccaaaatgtccatga

SEQ ID NO: 364 - DNA, 294 bp, Arabidopsis thaliana
atggcgaattgtatcagaagaaatgctcttttcttcttgactcttctctttttattgtcagtctccaacctcgttcaggctgctcgtggtggtggcaaactcaaaccccaacagtgcaactcaaagtgtagcttccgttgttcagcaacatcacacaagaagccatgcatgttcttttgcctcaagtgttgcaaaaaatgtctttgtgttcctcctggcactttcggcaacaaacaaacttgtccatgttacaacaactggaagactaaagaaggccgtccaaaatgtccttaa

SEQ ID NO: 365 - DNA, 321 bp, Arabidopsis thaliana
atggctaagtcatatggagctatcttcctcttgaccctcattgtcctcttcatgcttcaaaccatggttatggcctcaagtggatctaatgtgaagtggagccagaaacgttatggaccaggaagcctgaaacgtacccaatgcccatcggaatgtgataggaggtgtaaaaagacacagtaccacaaggcttgcattacgttctgcaacaaatgctgcaggaagtgtctctgtgtgcctccgggttactatgggaacaaacaagtttgctcctgctacaacaactggaaaactcaagagggtggaccaaaatgcccttga

SEQ ID NO: 366 - DNA, 306 bp, Arabidopsis thaliana
atggccaaactcataacttcttttctcttactcacaattttattcactttcgtttgtctcactatgtcaaaagaagctgagtaccatccagaaagttatggaccaggaagtctgaaatcataccaatgtggaggacaatgcacaaggagatgtagcaacacaaagtatcataagccatgcatgttcttctgccaaaagtgttgtgctaaatgcctttgtgtccctccaggcacgtacggcaacaaacaagtgtgtccttgttacaacaactggaagactcaacaaggtggaccaaaatgtccataa

SEQ ID NO: 367 - DNA, 750 bp, Allium_cepa
cttctgctagttgttgctcttttagcaattatgcttgttgaatccgctaagaatggatatggacaaggaagccttcgaagctatcaatgttctggtcaatgcgcaagaagatgctcaaagacacagtacagaaagccgtgccttttcttctgcaacaaatgctgtgcaaagtgcttatgtgtgcctcctggtttctatggcaacaaaggagtctgcccatgctacaacaactggaaaactcagcaaggaggacccaaatgcccttaattatttatctacttatctacacatatggttatatttatatatctatgcatcggtcttcaccataactatttatattgttatgttgttgttacttgcttgattaatttatttactaagtgtggcaactgttgttattgcccctaattaattacttatgtatcattgaaggaaagcactagttggtgtatgtgtcttttgaatctaatggaaatttttatttgggaattccagcaagagttgccgcccagatcaacaggccagtcgttcctccagcgtaaacatcaccattagctgcccattcttctggtgtgtagattgggctgtagccatcaacatttgcaccatatttgtcagcatattggtaaactccctttcccttgggtttcctccctgatgcatcaacaccatttctcaagttcatcccacctccagttccataaggggtgtcggtcttgatcttcttgactccgctagccttaacgc

SEQ ID NO: 368 - DNA, 568 bp, Allium_cepa
ctcctccaaccgtctccttctacaataaatttccaagtcatggcaaatagtacatgcattctgcttctttctcttcacttgttacttatcatagccaccgcaatccaggtaaagcatgctcatgcaccaactctacaaccagtgaactctacagctccaactgctcaacccaattatccttcgcatggattcactgaaggaagccttcaaccacaagaatgtggagggcggtgtgatgtacgatgctcagcgacacagtacaggaagccatgtatgttcttttgccagaaatgctgtgcaacttgccgctgtgtgccttctggtacttacggcaataagcagacttgcccttgctacaataattggaagactaaacgaggaggacccaaatgcccctgaaccttctgttttcctttcccttcctttgtccatctcatctgctctttctgtatatttgggtgaagcatgattgttccttttgtaccttaaatcgtaggttttatctttttgcaatgtcatcttattgtatgcatgtgtttccacagaaataaaacttaaattccgcttt

SEQ ID NO: 369 - DNA, 948 bp, Allium_cepa
ccacattttcccactatttaaattccaacccctctctttatcctctcttcctacttctctgtcgataatatcatcaaacagttcaatggcagccgccgcatcttccctctccctcctcccctcctcttcctcctcctccacccggtcttccgcccttcgatcctccctccgccctacccgccgcctctctttctcctcttccgccgccgattacagcctctctcttcacgtctcatccaaggcccgggctttttccacgcacctgaccaaaggtccgaggggcgtcgtctccatggccaaaaggagcgttggtgacttgagcgccgccgaattgaagggaaagaaggtgtttgtcagggctgacttgaatgtgccccttgacgataaccagaatatcactgatgatactaggattcgtgctgctgtgcctactatcaagtatttgatgagcaatggggctaaagttattttgtctagtcacttgggacgtcctaagggtgttacacctaaatacagcttggcacctcttgtaccaagactatctgaacttctaggcatcacggttgagaaagcagatgactgcattggcccagatgttgaggctaaggttgcagcacttccagaaggtggcgtgcttcttctagaaaatgttaggttttacaaagaagaagagaagaatgatccagaatttgcaaagaaacttgcttcacttgctgatctttacgtgaatgatgcatttggtactgctcacagggctcatgcatctactgagggagtaaccaagtttttgaggccatctgttgctggtttccttttacaaaggaaacttgataaccttgtgggagcagtttcatcccccgaagaggcatttgctgcaatagtgggtggatccaaggtgtcatccaagaatgggtgtgattgagtcgctattagagaaatgtgatattc

SEQ ID NO: 370 - DNA, 1086 bp, Oryza_sativa
atttcggtgctttcggctggctgcacagcacagccacaggagagctagctctcatcacgggccaaatccaagggggatatcgtatttcctgtgcatcgatcgtttgctcattcacgagctcacagactcagagtctcacagggagatcaaggagtcggagaaacctcctctgccttgcatgccagtgagtgagtgcgagagataggttcacttcagggtggttattggggtgagcacctgagctgatcagcagccatggagggcgtcggtgttggggttagaattagagcgctgctctgctgcattgcgatggcggcgatgcttctcagttcctaccagcaaggccaggccgaggcctcttacatgccatggccgccagctacgccgccgccacctgctgctgccgctgccaactccacctccaccgcggcggcgaacaactcgtcgtcgtcgtcgtccaccaccgcgccgccgcagcagccgaccgccttccccatgtacggcgtgacccccggcagcctccggccgcaagagtgcgggggtcggtgcgcgtacaggtgctcggcgacggcgtacaggaagccgtgcatgttcttctgccagaagtgctgcgcctcctgcctctgcgtgctgccggggacctacggcaacaagcagtcgtgcccctgctacaacgattggaagaccaagcgaggaggccccaagtgcccctagttaattcttttttttttcattttagcagcaaattaaaccaccattgttgagggagggagggagggagggaggaaggaagccgccatggctgcaagcttttcagcctttgctctgagctaaggcacggccctcatgcatccagagtttgttgaaattcagatgcgactctctgtgttcttttcctcttgttttttttttctgttctttttggggtatctctgctagagtggttgtttgtctgtattgatttcgtggatcttaaggtagaagatgagttgtcgagatgaattttgatcgtgatgtgtttcgagtttgtttgtaatttgtatgcagtattgaggagtaatttgtatgctactatgggttcttttc

SEQ ID NO: 371 - DNA, 666 bp, Oryza_sativa
caatcactcaaggcccctcctcctctctccatcaagagaagctctacctcggcccgtcctcgcccgccggccggccgccgtcgccatggctcccggcaagctcgcggtgttcgccctcctggcgtctctcctcctcctcaacaccatcaaggccgcagactaccctccggctcctccccttgggccgcctccccacaagatcgtagaccccggcaaagactgcgtgggggcgtgcgacgcgcggtgcagcgagcactcgcacaagaagcggtgcagccgctcctgcctcacgtgctgcagcgcgtgccgctgcgtcccggcgggcacggccggcaaccgggagacctgcggcaggtgctacaccgactgggtctcgcacaacaacatgaccaagtgcccgtgagctaagcgcgcacgaatacgatccgtctgcctgcctagatctagcttaatttagctttgcattgctcctagttgagtagttggtgttgtccgttgggtttctgtctttccagagttatccttttttctttttctttttttttcttcctgagagaagagagggtgttgacgagctgttactgttagtattctggacctctagtatgttttgttgtgtaaaaaaggactagtgaaatccatctcggcttgaatcacgcttgatat

SEQ ID NO: 372 - DNA, 354 bp, Oryza_sativa
atggatccagcatcacgctccctctccattattttcttcttagtcgcagtgacatttgtggttgaggtgtctgggcagaagaatgaagcagtataccatttgtttggtggtgaaggctcgctcaccaaaaatgagtgcccagggaaatgcagctaccgttgctcggccacatctcacacgacggtgtgcatgacatactgcaactactgctgcgagaggtgcctgtgtgttccatccggtacatacgggaacaaggaagaatgcccttgctacaacaacatgaaaacccaggaaggcaaaccaaatgtctgtgaactggggatagaagagaaaagaaatgatacaggggaatag

SEQ ID NO: 373 - DNA, 759 bp, Oryza_sativa
aaaaaaaaaaaaaaaaaaaaaaaaaaaaaaaaaaaaaaaaaaaaaaaaaaaaaaaaaaaaaaaaaaaaaaaaaaatggacactctccacaacaccccaactctgaagctgcttgcttggagtctaggaccagcattcacaagcacaatgaagctcaacaccaccaccaccctggctctcctcctgctcctgctcttggcctcctcttccctccaagtttccatggctggatcagatttctgcgacggcaagtgcaaggtgaggtgctcgaaggcgagcaggcacgacgactgcctcaagtactgcggcgtgtgctgcgcctcctgcaactgcgtgccgtcggggacggccggcaacaaggacgagtgcccctgctaccgcgacatgaccaccggccatggcgctcgcaagaggcccaagtgcccatgatcatttttgcattatgcatgctacatgatgcttagccatcatccgtagttgctttgcatgcatgatgcatgctcatgatcgagatggagtagtagatatatgcatatgcttgccatgatcgatcgtatggaccatgcaaagtatgcttgtttgtgtgaggatcgactcgatcttgagtctttccatgttcttggttttctttttttactgctagttaattactatggagtacatgtgaatatgacatcggatatgtaatgtatacatgcatgcctggtgataataatggtgtgtgtgctgtaataaagtgttggcttaattggtgtagtac

SEQ ID NO: 374 - DNA, 279 bp, Oryza_sativa
atggccagtatggccaagtcgctcttgtgcatctcgctcgtcgccatcctgctcctcgtcgagactactgctccacatggacaagcttacgccatcgattgcggggcgaagtgcgggtaccggtgcagcaagtcggggcggccgaagatgtgcctgagagcatgcggcacctgctgccagcgctgcggctgcgtgccgccgggcacctccggcaacgagaacgtctgcccctgctacgccaacatgaccacccacaacggccgccacaagtgcccttga

SEQ ID NO: 375 - DNA, 696 bp, Oryza_sativa
aaactcgtcttggaacccactgctttgcctataaatatgtagctatagcttctctgctttccgtcgcttaacacagttaacaccaacgcagtggtgctctctcttcagttagtggagcttcagagaaatggctttggctggtaggctacttgtcctcttcgccattgctctccttgccatctccatagccgagcacaaggcgctagccaagggatcaaccagtgagcatgatgataacgtttaccaagtaagcaagggaggacagggcagcctgaagagctatcagtgctcgccgcagtgcgcgtaccggtgcagccagacgcagtacaagaagccgtgcctcttcttctgcaacaagtgctgcaacgcctgcctctgcgtgccgtcgggcctctacggcaacaagggcgagtgcccctgctacaacaactggaagaccaagcgcggcggccccaagtgcccgtgaaaaaaccttcagtggacgctcgaattctttggtcatttcagtacccaaactctgctcgcacgatgccgattgattctagcatggccgtcggggcagaggcagctgtggcttcctatacattacatacacacggttgtaaaaatgtacatctgggctatccattgctgtacgcctgaacggttccagaggggtgatgcaaatcatgcagatgcagctgtatcgctaccacg

SEQ ID NO: 376 - DNA, 772 bp, Oryza_sativa
gcatatttgctttgctccccttccacgactttagccatcttggcttgcaaggtgagaagagcagatcgatcgagctgagagctggtctcaggtgtgtgttgcgtgagtgtgttcgaagacgaacgatgaagacccgccgggccgcgctgctaatgcttctcctcctggtggtggtggcggccgcctcgtggccgcagccttgcgacgctgcttcagggttctgcgggagcaagtgcgcggtgcggtgcgggagggggagggggcgggggagcgggtgcctgaggtcgtgcgggctgtgctgcgaggagtgcaactgcgtgcccacggggagtgggtcgacgcgcgacgagtgcccctgctaccgcgacatgctcaccgccggccccaggaagaggcccaagtgcccctgaatcctccccatccatctccatctcatcgattaccatcaacttcatctcattttcttgtacttgaaattagctactagtacgtggttgtgtatacgtcgcaggtgtgtatgtatgtatgtatatatatgcgtatgttgtcatgctgcgtagttatagttagtagtcctacctactccagtacgtacgtgttgatgcctgttaatatggctgtatggctagctaagctgtgtgcctgtgtcgatttgtaaagttgtactagtaggtagttgtactacttgcagcgcacgtactgtttgtttgtctgttgttaaatttcgtgttaactatgaacaggggatatgccgtatgcgctttacctgagg

SEQ ID NO: 377 - DNA, 2054 bp, Oryza_sativa
acagctcactacctatccatctaaaatctgattacacatttgcccattaaattctactatgcacaacaagaagccacgaattctactatgcacaacaagaagccacgactgtgctcttaattcaaatctgaatttgttaggacatattattgacgtataaccacataaataaatccaaagtatatataatatttttgtttccccatttcaaggtctatatgatcttacttatttggttttggtccgcatactggtagtatgcctgagagtggttatattgatgactgttaagagaatgacaagtcaatatcttgctttgatacctttttttttgcatttttgatttagctaaaaataactatgtactgataatggttatttttattgttacaaattccaattacatgaggatatgttttataaattttgggtaaataggttgtgcttcagaaggtgtagtttctaaaatttttagtgcaattatgtactcgggcgatatattttgtcaaaaaacgtgcattgcacgtgagtattagtagtgtgttactgtgttacagtccattgcatagaccattgggcacacacacgctgataagcacaagatccaaaagcaagtaaccgcccatggtatactatgcatgtacgaggccgacaaaagggaaagcaagccggtgatgcgcgtgaacactgcggcatagcgacaaggccacctgtccgccatggcattcatgattcatggccgtccctccccctgcgagattcccccactcacttgctcacacaccaaagaagctactggggcaggtgtgtccattgaattgaattgaattgaaactattgatgaatgaattcaccagccagctagaaccttccttgaaaccagccataaatcacacccattcatctctctcaactctctgcagcccattcactgcaccagtgtagtagcagtgctgcagttgctttgaacactcatctcctcaccgtgtttgttagagctcaaaaggatcaagagaagatgagggttcctcctcttcgtgccaccacggctctcctggccaccctcctggtcgccgcctcgttccaggatctcaccgtcgctgcagacggcggcggcggcgtggttccggtcccggatagcgtgtgcgacgccaagtgccagaagcggtgctcgctgaaggtggccgggcggtgcatggggctgtgcaagatgtgctgccacgactgcggcggctgcgtgccgtcggggccgtacgccagcaaggacgagtgcccctgctaccgcgacatggtctcccccaagagccgacggcccaagtgcccgtgagcaacgagagatggctggcactgtgacgatgtgtagccgatccgtggtagtagtgtgattgatagcgttgggatcgatctcggttctttgagaagtgttagtgcttagtggaataaaacaagaatgtctgtctaagatatgtcttgtgctttgtccagagtatgctctgatatcgctctgatatctaggccgagtttagttccaaattttttcttcaaactttcaacttttttatcacatcaaaactttcctacaacacaaatttctaatttttccattatatcgttccaatttcaaccaaatttccaattttagcgtgaactaaacacacaagttacttttgattattttttttaagcaacagaattgagaatgagggtgtgtttagttcacgctaaaattgaaagttttattgagattggaacgatgtaacggaaaagttagaagtttatgtatatagaaaattaaagttctgatgtgatggaaaacttggaggtttaaagaaaaagttgggaactaaaccagacctggatcatctggctcgagcaggggcggagctagtatatattaggggggtgcccagaaacctggtcaagaaaattttttagctatacctcatctattttcatcatgtatgtaccctctaaatacaaacttaggcatccgcatcagcttaaacttgatctaaagtagagtaaattaaacaagtgacaccaccatctatttc

SEQ ID NO: 378 - DNA, 1012 bp, Oryza_sativa
cgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgctttagtgtctggtaattggaatgagtacaatctaaatcccttaacgaggatccattggagggcaagtctggtgccagcagccgcggtaattccagctccaatagcgtatatttaagttgttgcagttaaaaagctcgatcacctccacctcgcaaacagaaccagtactttaatttcaccttgcaaattcagttgaattcggctcgttcaggttcagtcgtttgatcatcatggctagtatggccaagtcgctcttgtgcatctcgctcgtcgccatcctgctcctcgtcgagactactgctccacatggacaagcttacgccatcgattgcggggcgaagtgcgggtaccggtgcagcaagtcggggcggccgaagatgtgcctgagagcatgcggcacctgctgccagtgctgcggctgcgtgccgccgggcacctccggcaacgagaacgtctgcccctgctacgccaacatgaccacccacaacggccgccacaagtgcccttgatcatctcgaccaatatatcaccgctcgatcaccgcgccgccgctttgctatccaaccgaccggtgatgatacatggcggcaaccttgtgatgatcctagctagctagatgtgctacctacttcgtgcctgcatgcatgtagcttgcatatgcatgctagttttgctatatcgcgtatttgctacttggaatatgtatgatgtgtgtgcatatatatgtggcgtgtcgtgatcgatcgatcgatcgaccgtgtacgagcaaataagtaatataatgaagtatttgctttt

SEQ ID NO: 379 - DNA, 433 bp, Oryza_sativa
acaatctctctaacctctccttcaacctgattactatatatcttgaatcttgggttaatcttgacgttcttgttcgttcttgtttctcgcgtgcaggaggtgatggcaggagggcgcgggcgcggcggcggcggcggcggaggggtggccggcggcgggaacctgaggccgtgggagtgctcgcccaagtgcgcggggaggtgctccaacacgcagtacaagaaggcgtgcctgacgttctgcaacaagtgctgcgccaagtgcctgtgcgtgccgcccggcacctacggcaacaagggcgcctgcccctgctacaacaactggaagaccaaggaaggcggccccaagtgcccctaagatgcatgcctttttttctttcttcttttttttttgtttttttaccgtatgattaatacctcctactagttctact

SEQ ID NO: 380 - DNA, 698 bp, Oryza_sativa
actctccacaacaccccaactctgaagctgcttgcttggagtctaggaccagcattcacaagcacaatgaagctcaacaccaccaccaccctggctctcctcctgctcctgctcttggcctcctcttccctccaagtttccatggctggatcagatttctgcgacggcaagtgcaaggtgaggtgctcgaaggcgagcaggcacgacgactgcctcaagtactgcggcgtgtgctgcgcctcctgcaactgcgtgccgtcggggacggccggcaacaaggacgagtgcccctgctaccgcgacatgaccaccggccatggcgctcgcaagaggcccaagtgcccatgatcatttttgcattatgcatgctacatgatgcttagccatcatccgtagttgctttgcatgcatgatgcatgctcatgatcgagatggagtagtagatatatgcatatgcttgccatgatcgatcgtatggaccatgcaaagtatgcttgtttgtgtgaggatcgactcgatcttgagtctttccatgttcttggttttctttttttactgctagttaattactatggagtacatgtgaatatgacatcggatatgtaatgtatacatgcatgcctggtgataataatggtgtgtgtgctgtaataaagtgttggcttaattggtgtagtacatgttcagtttagtgtgcc

SEQ ID NO: 381 - DNA, 419 bp, Populus trichocarpa
ctgcaaatcaagccttgctgatataaaaaaatgaagctctcttttgcagcactgctgctactttcagtggtcctcctgtcctctttccttcggttcaccatggctgtgcccaaccacgtcgcgtcacctccacctccctccccagcaattccaagtttctgtgatccaaagtgcaaggctaggtgtgccaaggcgggatactaccaacgctgctatgactactgtataatctgctgcaaagattgcaagtgtgtgccttcagggacttacggaaacaagtcagaatgtccatgctacagagacaagttgaactcaaagggcacctccaaatgcccttaagaaatccattatcccaacctttattttcccttttcactcaataaaatgcaacaacttgtacttagacatttccaaaaact

SEQ ID NO: 382 - DNA, 416 bp, Populus trichocarpa
agtctccaagggtctaattaagctttatcaatggctatttcaaagcttttgattgcttccctgctcgtatctcttcttgtgctccatcttgccgaagctgatcagaaggtgaactcaaatcaagctgcaagccatgttcctggaaacaatatcgactgtggtggcgcttgccatgctaggtgttcgttgtcctctaggcctcgtctttgcaagagggcttgcgggtcatgctgtgcccgatgcaaatgtgtccctcaaggcacttccggcaacctggatacctgcccttgctatgccaccttgactactcgtggaggcagacgcaagtgtccttgaaattagtcagccaattagcccatcagtaaaatcaacgcattctctacatgtatcaataattaataaccattggagttcca

SEQ ID NO: 383 - DNA, 476 bp, Populus trichocarpa
  misc_feature (141)..(190): n is a, c, g, or t
ctaaaaacaatctcttaaaaataggtagccatggatccagagacggcgttagagctggtaaagcaaggagccacactcctcctcctcgacgtccctcagtacactcttgtcggcattgacactcaggtactagagattttnnnnnnnnnnnnnnnnnnnnnnnnnnnnnnnnnnnnnnnnnnnnnnnnnnaagaagctacttcactcatctccccggcaagcaccagatgtaattaccgctgctcagcaacatcacacaagaagccatgcatgttcttctgtctgaaatgctgtgcgacatgcctctgtgttcctcctgggacttatggcaacaaggaaacatgcccttgctataataactggaagaccaaggaaggaagacccaagtgcccttgacctcgaggcttagctagttagctaccttcgatcaaaaactaaagacaataaaaatagacgcctagaatcccattctcatt

SEQ ID NO: 384 - DNA, 323 bp, Populus trichocarpa
ttatcatccttgcttgaggcaaaacaaaagatgaagaagctcttctttgctactttgctgttgtgttcactcctcttcagctcgtctttcttggaacctgtcatggctaatactgtggaatatgctgcgaacagtgcaagtgtgtgccctctggaacttatgggaacaagcatgagtgcccttgttacagggacaagaggaactccaagggcaagcccaagtgtccttaaatcaacctcttagacagtcaagatgtgcatgtgttgagaaagatatcatgtatatgagctagcagtactgtaacagttctcgagactcgaata

SEQ ID NO: 385 - DNA, 413 bp, Populus trichocarpa
gttacagtagctctctctgcttacaacaagatgtcgaggaagccaagcattaatgctaacatcacagaggctccaacccctcagccccaaccaaatacaaatagcaaccgtccaccgtatggcaccactcaagggagccttaatcctcaagagtgcggacctcgttgcactggtagatgctccaagacagccttcaagaagccatgcatgttcttctgccaaaagtgctgtgccaagtgcttgtgtgtgcctgctggaacttatgggaacaagcaatcttgtccctgctacaacaactggaagaccaagaggggaggccccaagtgcccttgaagacctaattaatcgattatctctctcccttttctgcctcaatgtagcttcctctgttcatttatattgttccaactggg

SEQ ID NO: 386 - DNA, 434 bp, Populus trichocarpa
gaagaagggttttgccttgtagctaaggccatggctaagtttgttgctgtcttcctcttggctctcattgccatttccatgctccaaaccttggttgtggcatcccatgggcgtggaggtcaccacaataacaacaagaacaaatatggacctgggagtctcaagagcttccaatgtccatcacaatgcacgaggaggtgtagcaagacccagtaccataagccatgcatgttcttctgtcagaagtgctgcaagaagtgcctctgcgttcccccagggtattatgggaataaagctgtgtgcccttgctacaacaactggaagaccaaggaaggagggcctaagtgcccttgaacaataattaatttcccttccctggtctccttttactatattatatgtatcaagtgttatgctctcggaatagcagtaac

SEQ ID NO: 387 - DNA, 398 bp, Populus trichocarpa
ctagtctccagtggtgattatactttagcaatggctatttcgaagcttttgatcgcttcacttgtcgtatctcttcttgtgctccagcaggtgaacgcaagtccggctgcaggttctattcctgggaaaaacattgattgtggcggggcttgcaaagataggtgttccttgtcctctaggccacatctttgcaatagggcttgcgggacatgctgtgcacgatgcaaatgtgttcctaaaggcacttccggcaacctagatacttgcccttgctatgccaccatgactactcatggtggcagacgcaagtgtccttgaaatcagcctttacctacttgtaaaaagcacagtgattctctacatatatcaaataatccttggagttcgagtaatatagc

SEQ ID NO: 388 - DNA, 374 bp, Populus trichocarpa
ctttctttgttaggcctctaaaattagcaaatgcaggctccatccctgtttgtgtttatttatttagttctcgaaatactcatcatgttggtgatttcttgtggtgtagctttctgtaccaagaagtgcaatacgaggtgcgcaaacgctggcatacaagacaggtgcttgaagtactgtggaatatgctgtgaacagtgcaagtgtgtgccttctggaacttatgggaacaagcacgagtgcccttgttacagggacaaaaggaactccaagggcaagcccaagtgtccttaaatgataatctcttacacagtcaggatgtgcctgtgttgagaaagtaagatctcatgtatatgtacgagctagctgtgtat

SEQ ID NO: 389 - DNA, 452 bp, Populus trichocarpa
ttatactgttcatttctccccaccaagaaaatgggcaaatcaagcattgccatttttttatgctctctgctggtgcttgttctgctaggacaaaaccaggctcttaaaacaccaatctcagcttcacagacacaacgacagggcaaccatgcaatgtatggggccactcaaggcagtcttcgtcctcaggaatgtgcaccaaggtgcaccaccaggtgctcagccacagcatacaagaagccatgcttgttcttctgccaaaagtgctgtgcaaagtgcttgtgtgtgcctcccggcacgtatgggaacaaacagtcttgcccttgctacaacaactggaagaccaagagaggagggcccaaatgcccttgaaaattcatgtttctactcgaccgtccccttccagcagctacttaatttattagtaatcgctatatatatatgtaaccagt

SEQ ID NO: 390 - DNA, 848 bp, Populus trichocarpa
tttgttgctgcttcacctctggtcctgacaatggctttcaaagctgtttgtcttatggtggttgcttttgttttagttactgcaaaggcttcatacatgaatgaagacttcaaggagaaggctgttttttccaaatctgtggtgcctgcatcaactcctgctcctccagaggtcaagtcaccgacccccgccccaccagtggtcactccttccacaccattgtacaaaccaccaactcccgcgccaccagttaagacaccacctccagcaccgccagtcaacccccccacacctgtgaagccacccactactcccgccccaccggtctacaagccaccatctccagcaccgccagtcaacccccccacacctgtgaagccacccactactcccgccccaccggtctacaagccaccatctccagcaccgccagtcaacccccccacacctgtgcctcctgtgaagccacccactgctcctgccccaccggtctacaagccaccatctccagcacccacacctgtgcctcccgtgaagccacccactactggaccaatgcccccgccagttaggacaagatcggattgcacccctctatgtgggcagaggtgtaagttacattcaaggaaaagactgtgtgttagagcttgcatgacttgctgtgacagatgcaaatgcgtgccgccggggacttacggcaacagggagaaatgtggcaagtgctatactgacatgaccacccgccgcaacaagcccaagtgcccttgaattttttaaaaatctcgactgtgatatatgttattgctattatgttatactatatagtttaagaataaacttttctcata

SEQ ID NO: 391 - DNA, 311 bp, Populus trichocarpa
ttttcctttccagctttgatacatactgcgatggattcaatccgctattgtggagggttatgcaagcagagatgcagtcttcactcaaggcctaatctgtgcaacagggcatgtggcacctgctgtgtgagatgcaagtgcgtgcctcctgggacctcagggaacagagaagtgtgtgggacatgctatactgacatgaccacccatgggaacaagaccaagtgcccataggaccaagaaccgtgggctttgggtagctttctgtcttgggttctcttttcagcttttgtctaatcaaatgataataatgt

SEQ ID NO: 392 - DNA, 377 bp, Populus trichocarpa
ccacacatactttcagatcatataacagaaatgaagcctgtttttgcagctatttttcttctgtgccttgttttcagttcctctttgtttgaggtcacaatggctgcctcgggattctgtgactcgaagtgctcagtgaggtgctccaaagcaggaattaaagaccggtgcttgaagtactgtgggatttgctgtgaaaagtgcaagtgcgtgccatctgggacttatgggaacaagcacgagtgcccttgctacagggacatgaagaactccaagggcaaacccaagtgcccttgatgttgtataatgatgccgagtgttacagatgtatgtctgcatgttgagctgggtcgtaaaactactagtaattaggtcgt

SEQ ID NO: 393 - DNA, 386 bp, Populus trichocarpa
aagcgttttcctgtcctaagaaagtttgaaatggtcagtgccaagacaacatttatcttggcaatactttgcctggccctaatgcatgagcttcagatccgtactgttgaagctgggaaaataaattgcaagtccaagtgtgaatacaggtgcagcaaggcatcgaggcacaaaatgtgcataagggcttgcaacacatgctgtcagaggtgcaattgcgttccacctggaacttctggtaacgaagatacctgcccttgctatgccaacatgaccacccatgggggtagacacaagtgcccctgaatcaatccatattcttgcagacctggcttatgaatatctatgataagcacaggttacgaatttattatgaatagtagaag

SEQ ID NO: 394 - DNA, 392 bp, Populus trichocarpa
taacttcaagaaagtggcagctagctagccatggcagtgcgttcgcttcttgctttgatggtttttgttttctgccttgcagagcttgttgtgagaggtggaaacaggaggctcatgcaagacatagactgtggagggttatgcaagcagaggtgcagtcttcactcaaggcctaatgtgtgcaccagggcatgtggcacctgctgtgtaaggtgcaagtgtgtgccgcctgggacctcagggaacagagaagtatgtggaacatgctatactgacatgaccacccatgggaacaagaccaagtgtccataggcctgtgaaccagggagattgtgtagccttttatattcgcagctggaaactgggatctctttcagcttttgtctaatcaa

SEQ ID NO: 395 - DNA, 398 bp, Populus trichocarpa
aagagagagagagagagataacagagcaccatggctagcctcagtcgcaattccctcttggttgtcctttctctctgtcttctaattacattttctaacgtggctgagatccatggtgccaagctccgtccttcagaatgcaaaccaagatgtaattaccgctgctcagcaacatcacacaagaagccatgcatgttcttctgtctgaaatgctgtgcgacatgcctctgtgttcctcctgggacttatggcaacaaggaaacatgcccttgctataataactggaagaccaaggaaggaagacccaagtgcccttgacctcgaggcttagctagttagctaccttcgatcaaaaactaaagacaataaaaatagacgcctagaatcccattctcatt

SEQ ID NO: 396 - DNA, 317 bp, Populus trichocarpa
ggagaatacttcgtgcctaatcatgcatgcatgttaatttggtttcgtttttcagattgtggaagcgcttgcaaggcaaggtgccagttatcatcgaggccacgcctgtgcaagagagcatgtgggacttgttgttcaagatgcagctgtgttcctccaggaacagccggtaactatgaggcttgcccctgctacgccagcttgactacccatggcggcagacgcaagtgtccttgaagcacatctaatttccgagcatctcatgattttaatcatacttatgttagatttttgtaaataaaaagagtggaaagaaa

SEQ ID NO: 397 - DNA, 350 bp, Populus trichocarpa
cccagtatgcaaatcactttttggatgcagatggatgaagaaagcgatgtggtagctattgataagaaacattatcctaaaagaatcaattgtggttatttatgcgcaaggagatgcagggcatcgtcaagaaagaatgtatgccacagagcatgcaaaacctgctgcaacagatgccggtgtgttccaccaggtacctatggcaacaagagtgcatgcccatgttatgcaagccttaggacccatggaaacaagcccaagtgcccttaaatttcatgcaactatgtagtttctggagtgcaggacatccaaatgtcttttgaatgttgattctactatttcctagctgg

SEQ ID NO: 398 - DNA, 492 bp, Solanum_lycopersicum
tgaagttatttctattaactctgcttttggtcactcttgttattaccccttctttcattcaaactactatggctggttcatatttttgtgattcgaagtgcaagctgagatgttcaaaggcaggacttgcggacagatgcttgaaatactgtggaatttgttgtgaagaatgcaaatgcgtgccttctggaacttatggtaacaaacatgaatgtccttgttatagggacaagaagaactctaagggcaagtctaaatgcccttgaatttgatgtattttaaatatctaagtggttaaatttggtctttacatattaagttttctaggtatgttaaagttatacatataatttgaaaactagaagaaaaaaaaaagtttgttatattaataaataaatgggttcttctttgaactcttagggtaattttctgatttgttataaatgtaatatgattttgaattcacataaataataatttactgtttggttt

SEQ ID NO: 399 - DNA, 725 bp, Solanum_lycopersicum
acctagacttaagctaagttttaagcaggagctgcggttataatatacatggcgatggcgcttcgtgtactgcttcttttagttttatttttccttactgttaaggcacaggattctattattgatctcaaggaagttgaagaagacaaacaacaacatgttggtctcagccaggcacttcgtgttttcaccagaggagccaatagaaggctagttcaagacatagttttaaaggttgcaaaatacttgaacaatggggatattgctctagctccagcaccagctccacctcccagtccattggattgtggaggattgtgcaaatacagatgcagtttacactcgaggcccaatgtgtgttttagggcatgtggaacatgttgtgttaggtgcaaatgtgtgccaccagggacctttgggaacagagagaagtgtggcaaatgttacactgaaatgactacccatggcaacaagaccaagtgcccttaatttattactagtaattattttacgagtgtgtatgtggaccttagcatatttaattttatcatatctttatgagatagtaatagcaaatcatgtctggctacattgcagtatatatcttgctgctaagccatgtgcaagttgcggtggtttgaaaaatattgtatgattatgttttacccatgtttatgttgatatatgtcatcacttggttgctatttgttcaaagtggcggagtt

SEQ ID NO: 400 - DNA, 819 bp, Solanum_lycopersicum
atcggccgaattgataaatcaattttttggagaaaaaatctcaaaaatatttcaaattccaatggccatttctaaagctctctttgcttcattacttctctccttgctccttctcgagcaagtccaatctattcagactgatcaagtgagcagcaatgctatttctgaaggcgctgattcctacaagaaaattgactgtgggggagcttgtgcagcaaggtgccgattatcatcaaggccaagattgtgtcatagggcatgtggaacttgttgtgctagatgcaactgtgttcctcctggtacttctggcaacactgagacttgcccttgctatgccagtttgactactcatggcaacaaacgtaaatgcccttaaatttcttctaaaaatatcgtatatcgtgtgattaccacggatatgttattattgtagtgtattattttgtcatatattgtgtcaataatcaaaatccagtaaaatatctttagcgtgggtaatttattttttggggtgttgtctttgtaattttgaggaaattttatttgtgtgttgattagtacatctggtgtaatatttattctggtttgcattgtattgtataataagatgaggaataaatgaagtttgagtatattaaaaaaaaacaccaattaacatgaagaagtacgagactctgtcgtaccttcctgatttgtccgacgagcaattgctcagcgaaattgagtacctattgaaaaatggatgggttccttgcttggaattcgagactgagcacggatttgtgtaccgtgagaaccataagtcaccaggatactacg

SEQ ID NO: 401 - DNA, 508 bp, Solanum_lycopersicum
tggttacaatgctagcttcttgttacttatctcaatgttcttgattttgctcactttctctaacgtggtcgagggttacaacaagctccgcccaacagattgcaagccaagatgtacttatagatgctcagcaacatcacacaagaagccatgtatgttcttttgtcaaaaatgttgtgcaacatgtttatgtgttcctaaaggagtttatggcaacaaacaatcatgcccttgttacaacaattggaagactcaagaaggaaaacctaaatgcccttaattaattaaaatattaataattagggaaattaatctttttttcccaataattaatggaaaagattaagagtactatagctatatgggcatattgtgttttgtattgcattaaattgatttggaagaattttgatgtaatggtttaagcattttggatttctctacttggggtatcatggtggctgagctgaattgtagtactggagcgatatatgatctatgtattagg

SEQ ID NO: 402 - DNA, 612 bp, Solanum_lycopersicum
gctcttagcttcacacaaaattactacaatggctgggaaaatgagcattgtcttgtttgttcttttggtggttttcctgactcaaaatcaggtttcaagggccaacattatgcgtgatgagcagcagcaacaacagagaaataaccaactgtatggtgttagtgagggaagactccatcctcaagattgtcaaccaaaatgcacgtaccggtgttcaaagacatcgtataagaagccgtgtatgtttttctgccagaaatgctgtgcaaagtgtttgtgtgttcctgctggtacctatggcaataagcaaagttgcccttgctacaataactggaagaccaaaagaggtggcccaaagtgcccatgatcatccatattgtattaaaatgtgactgcagacacccaacttctgtcaaatctagtagttaatcaacacttgttgtctcaagtggtgtattagctagtaatgttaggtcccaattatatagaagaagattgggctagctacaagtacaatagcatggttatgattatgcagctttttttgtgagacttattttatattattattatgattatatcttaagtgatatttatgtggtgtaccataag

SEQ ID NO: 403 - DNA, 512 bp, Solanum_lycopersicum
aatgtgtgttagccatggccatctccaaatttcttcttgttactatggttttgatttctctacttgtttttcgtcctgtggaagctaatggcaacggtgacggtgacaatttagcggtgcacacggctggaccagagggtgctaacaaccctacttacatccctacatcagagtgtggaacagcatgtgaggcaagatgtagtctagcatcaagacataaaatgtgtttgagagcatgtgggacttgttgcactcgttgtaattgtgtgcctccaggcacctctgggaaccaagatctttgcccttgttaccgtgacatgctcactcatcatggcaagcacaagtgtccctaaatatatatatatatatatatatacttatacatagtaatatatgtataacataaaactttttaagaagtgatcaaaaataaaacgcgataaattttagatgatttttagatattttatttaattttttatcggcttgaaaatttgcgatttcttttgtat

SEQ ID NO: 404 - DNA, 706 bp, Solanum_lycopersicum
atttatcttctcttcttcttaaatattttattttccttcaaactatatagtaatttcactttccatttgaagagaagaaaaatggcaaagagtggttacaatgctagcttcttgttacttatctcaatgttcttgattttgctcactttctctaacgtggtcgagggttacaacaagctccgcccaacagattgcaagccaagatgtacttatagatgctcagcaacatcacacaagaagccatgtatgttcttttgtcaaaaatgttgtgcaacatgtttatgtgttcctaaaggagtttatggcaacaaacaatcatgcccttgttacaacaattggaagactcaagaaggaaaacctaaatgcccttaattaattaaaatattaataattagggaaattaatctttttttcccaataattaatggaaaagattaagagtactatagctatatggtcatattgtgttttgtattgcattaaattgatttggagtaattttgatgtaatgttttaagcattttgtatttctctacttgtgttatcatgttgtctgagctgagttgtagtactggagcgatatatgatctatgtattaggattcatatagccgttttcaacttgctcggagatgaagtgttattgtaatctttcttttttataacgagactataataataacttatttattgaatcgagtttgttc

SEQ ID NO: 405 - DNA, 551 bp, Solanum_lycopersicum
tgtagaaggctttctcagttcttaagagctctctgttttctccttccttcgtgtatacacacaccattttgtgtttttgtttttgaaacaatgacggtccaaaaggcattcgttgcaatgcttattgcatcctttctactagtccatttcgctaatgctcaaaaggttgactacagcaagccaccagcatcagcccctcaaggtccacagccactagattgcataggagcttgtaaatatcggtgcagtgagtcgtccaggcaaaatctatgcaacagagcatgtggaagctgctgccatagatgccactgtgtgccaccagggacttctggaaattatgaatcatgcccttgctatttcaatcttacgactcataacaccacccgcaaatgcccttaatccctttttcttagtttttaaatttgttccccaaaggaagtccattttcaaaaaaaaaaacagagtgtaactttcaattcaattcaatgttccttctgtttacgaagcttgtgatgatgcaataatacataagtatttataactttgttcat

SEQ ID NO: 406 - DNA, 553 bp, Solanum_lycopersicum
gatttacttctatactctcattttcaccaagaaaatcaagcatggccaagattgtttcagttctccttttggcccttcttgtcatttccatgcttgctaacactgttatggctgcaaatggcaaacaccaccactatgctaagaagtatggaccaggaagcttgaagccctcgcaatgtctaccacaatgtacgaggaggtgtagcaagacacagtaccacaagccatgcatgttcttctgccaaaaatgttgcaacaagtgtttgtgtgttccacctggtacctatggaaacaaggctgtttgtccttgttacaataactggaagaccaaggaaggaggacctaaatgcccttaatttactttctgttttcatctaatatgtctacctaatcttcttgttttttctcctattgcacttttatctaacccaagtggttatatatgtaatatgaccatatttccagagtttaaatggaacaaaaatatcactcccactcttgctagaaagtttaatcttcctttggaccaaacaaatttccatctttcctcatt

SEQ ID NO: 407 - DNA, 549 bp, Solanum_lycopersicum
accaactgtatggtgttagtgaggggaagacctccatcctcaagattgtcaaccaaaatgcaccgtacccggtgttcaaagacatcgtataagaagccgtgtatgtttttctgccagaaatgctgtgcaaagtgtttgtgtgttcctgctggtacctatggcaataagcaaagttgcccttgctacaataactggaagaccaaaagaggtggcccaaagtgcccatgatcatccatattgtattaaaatgtgactgcagacacccaacttctgtcaaatctagtagtattaattaattaatcaacaccttgttgtctcaagtggtgtattagctagtaatgttaggtcccaattatatagaagaagattgggctagctacaagtacaatagcatggttatgattatgcagctttttttgtgagacttattttatattattattatgattatatcttaagtgatatttattgggtgtaccataagaattatagaatgttcaagtcatctaatccaaggccaactctggcgtttgaatgggctattatact

SEQ ID NO: 408 - DNA, 583 bp, Solanum_lycopersicum
ctcgtgcctttctctcttttgttcaattaatatatcaagaaaacaacaaaatggagaagacacttagcttagtgctaatactccctcttctaataatgcttcttcttgttggaactcatgcaaaaataataatagaatctccagcacctcagccacaacctcctaacactttaccaatgaatggtactactcctggtagtctccatcctcaagattgtttaccaaagtgcacatatagatgctcaaatacacaatataggaagccatgtatgttcttttgccaaaaatgttgtgcaaagtgtctctgtgttcctgctgggacttatgggaacaaacaattttgcccttgttacaataattggaagactaagagaggaggcccaaaatgcccttaatcatatatgcactgacgataaaaagaagttttatattacgagtttactaaattaattatttgttataaaataatgtttgtagtatttttaagttacgagtttcgcttattataaatcatctcatgtaattatgttttaagggattgaatagaataaattattttattttatcattatataaaatatta

SEQ ID NO: 409 - DNA, 815 bp, Solanum_lycopersicum
gagagagagagagagagagagagagagagagagagaggcaggagattcaaggagaagaaagaaaaaatagaaccagaagctgatccagaaagggaccagagaactgtttttgcttaccagatgcccttgaaggcgactgaaagggatgtgtatgagtttttctcacaagcaggaaaggtgagggatgtgcggttaataatgtacccaactcctttagatcgccttgaatttcggtccatgccagctcagatttcagagttctcagctttactttttttttggtatcttaaacaatggcatccctaaagggatttgcagctttgctcattgcatcacttgtgcttgttcatttcacttatgcccttcaagaggtaattagcggcaaaccaccagcaccaagtcctcaacctccaaagccaatagactgtacgggatcttgtaaaacgaggtgcagcaaatcgtcacggcaaaatctctgcaacagagcatgtggaagttgctgccgtacctgccactgcgtgccaccagggacttctggaaattacgaagcatgcccttgctatttcaaccttactactcataacagcacccgcaaatgtccttaaaaattcatagcataattttgttcttcgtctgcaaatttaaatgtactagtatttcttattgaatactactattatattgtgtactatgaaacgtgaactgttgattttgaaattttaagtgtaaaattgaaggttgagagttttcagtgcaatattaaaatgggtgggtactattaaattcattgactctggtcgtcccatttactgtac

SEQ ID NO: 410 - DNA, 702 bp, Solanum_lycopersicum
gctgcacccgttgaagttggcacaatgttgagagctgcagctcttgcacgtctaaggtccttgtggcttgcatcaagcagcctttggtcaccagtgtaggagtgtgttgttgtttacttttttttaaaaaaaaacatgaagattttcacattatttctcattttcatcctcctcatacaggttttcgccaatgctgctactgaacagatagaggcaggcaatgaaggagctcttcacaaaaaaattcacccaattaagaggatacactgtggatacgcatgtgcgaggagatgcaagaagtcgtcaagaaagaaggtgtgcatgagggcatgcaagacatgttgtgcaagatgcaagtgtgttccaccaggcacttatggaaacaaggaagtttgcccttgctatgctaggcttaggactcatggcaacaagcctaagtgcccttaattaatttataattttttaaattaagaaaaagaaacaatgcatattatttatgaaataaatgctatagattttaattaatttctccatttttctgttttaatactgttgggaaggagggggtggggtttgagggaataaaatgagagaaattgttgcatgagtgtatgcaagtgtgcttttgaatatttgattatgactcctttgtttgtgagataaaattaatacatataaatgtattttatgtattttcttgat

SEQ ID NO: 411 - DNA, 442 bp, Solanum_lycopersicum
tcaacactccattggaaggttcaattggtgtaacacctagagatgaggcttcttcacatttttttggctttgctcattatggcttcaatgtcaagagctcaacctcctgttggtccaacaacttgtcctgtgcctaaagataaatgtgaagaggcatgcaatgtgagatgttcacaaaaaggtcacaaaaaaagatgtttgttttattgcaaccattgttgcggatggtgtcaatgtgttccaccaggttatgttggtgaaaataaagattgttgtccttgctatagagattggaagaaacagacaggagaaccaaaatgtccatgaaattaaaaattaattaaattaatttatcatggattaacaatatggtttttattgtattaatactttatttgatcttcttgagagtgttgttaatatatctttaacttttttatgc

SEQ ID NO: 412 - DNA, 700 bp, Solanum_lycopersicum
  misc_feature (357)..(357): n is a, c, g, or t
  misc_feature (562)..(562): n is a, c, g, or t
tttttttattgattcaaacaataggggaaaagatcgtacagttccctaccgagacaaactctcaacggatcctccgcgcgctgggaatacctcttccgtgcgtctttctcgtggcgggaacagaacaacagggaaagacccggcccagggcgagctttatttatttaagagagaatggggagtgaatcgaattccgtttccgttctttgggggctttcgggcccctctcgatctttttcgtagttgagaagggggaaggagtctaaatcaatggacattaatggttcacacaaaggtcacaaaaaaagatgtttgttttattgcaaccattgttgtggatggtgccaatgtgttccnccaggttatgttgggcaaaataaaggatgttgttcttgctacaacaattggaagacacaaataggaggaccaaagtgtccatgatatttatatattaatcgtggaaaaatagtttgtcggagaatcttagtagttcagttagttgtattggttgactggtttacttggattttcactttgttggtgattgttcgattctccgccntgtaattttctgtcttcattgtatacgttttatgtgtatttttcttttatttgttcttctcgaggaagtgtattttttcctatcgtagcgtaggaagagatatctttctctttattagagccaagatcgtacgaggag

SEQ ID NO: 413 - DNA, 569 bp, Triticum_aestivum
  misc_feature (193)..(193): n is a, c, g, or t
  misc_feature (240)..(240): n is a, c, g, or t
  misc_feature (286)..(286): n is a, c, g, or t
  misc_feature (329)..(329): n is a, c, g, or t
  misc_feature (360)..(360): n is a, c, g, or t
  misc_feature (388)..(388): n is a, c, g, or t
  misc_feature (435)..(435): n is a, c, g, or t
  misc_feature (441)..(442): n is a, c, g, or t
  misc_feature (452)..(452): n is a, c, g, or t
  misc_feature (492)..(492): n is a, c, g, or t
  misc_feature (498)..(498): n is a, c, g, or t
  misc_feature (505)..(505): n is a, c, g, or t
  misc_feature (529)..(529): n is a, c, g, or t
  misc_feature (548)..(548): n is a, c, g, or t
  misc_feature (552)..(552): n is a, c, g, or t
  misc_feature (558)..(558): n is a, c, g, or t
gttcacatcgctcttacccagccacacgcggagaagagacccagcaagcgccatggccaagatctccttcctcctcgtggcgctcctcgtcctcgccgtcgcgttccccgtggaggtgatgggaggcggcaacggcggcgccggcggcggcggcaagctcaagccatgggagtgctcgtccaagtgctcgtcncggtgctcggggacgcagtacaagaaggcgtgcctgacctactgcancaagtgctgcgccacttgcctctgcgtgccgccgggcaactacggnaacaagggcgcctggccctgctacaacaactgggaagaacaanggagggaaggcccaaagtgccctagaatccntgaatttccttcctcctcctccgggggngcaacttgcggttgatggtattcactggctccggcatcaaaatgttntacagnnatttttaatntgtggtgggggatttatcaattgggaattgggattggccncccaanttctgtnttttttcaaaaaaattgggaaatngggggacccgcaatcccanatgntttttnggggccttcca

SEQ ID NO: 414 - DNA, 832 bp, Triticum_aestivum
  misc_feature (752)..(752): n is a, c, g, or t
  misc_feature (756)..(756): n is a, c, g, or t
  misc_feature (781)..(781): n is a, c, g, or t
  misc_feature (793)..(793): n is a, c, g, or t
  misc_feature (807)..(807): n is a, c, g, or t
  misc_feature (809)..(809): n is a, c, g, or t
  misc_feature (831)..(831): n is a, c, g, or t
gcatcaaagaacagacagcacaacaaaggtacaaagtctagaaacccaaatgcgagaagacgttacatggaagcactcctcctcaaaccagatctacgttgtttattctgaacaaatcaaacttacaaacaaggggagcccctaaatcccacgcactcggctcgtcaagatccatctcctacgttcccattcaccttaaaaaaaaagatgaatggtggtagtcctaggggcatttggggcggccgctcttgggtgatttcatgtcccggtagcaggggcactcgtccttgggggccaacggccccgacggcacgcagccggcgcacttgccgcagcacatcatgcacagccccatgcaccgcccggccaccttctgcgagcaccggttcttgcacttgccctcgcacacgctgtccaggaccggagcgccgctgccgactccatctgcatctgcatctgcagcagccacggcgagatcctggtacgaggcggcgaggaagagggccaggagagccagggtcaccgggagaggcttcatcgccgtacgtctcttcttcaactttgtccaagagatgtttggcaaaagcagccgcttatttggctgaggagaggtgaaaatgcaacgaagctctctagtttgattcctggatcccgtgccctgcatggagatatcgcacaagctcaacgtgaagtcgtcattgctggatttaggagcgggaagttccttgttttggttgctacaaatgtggcancaanaggccttgacattaatgatgtgcancttatcattcantgtgaacctccacncnatgttgaagcctacatacatcng

SEQ ID NO: 415 - DNA, 1013 bp, Triticum_aestivum
  misc_feature (8)..(8): n is a, c, g, or t
agaattantacggttatccgagtagcacgtacccatcaaacaaactataactgatttaatgagccattcgcagtttcacagttcaaattggttcatacttgcacatgcatggcttaatctttgagacaagcatatgactactggcaggtttcttccacatttcccctgagcaaagagaagcaaatcacaagaaagcgaagcaaatcggcgggatggccggccaagctagggcgttcatgtgcgtggcgctcgtcgtcctcctgctcctcgtcgagaccaccgccccgagtggacaagctcacgccgtcgattgcggcagcgcgtgctcgtaccggtgcagcaagtcgagccggccgaatttgtgcaacagggcgtgcaacacgtgctgccggcgatgcgactgcgtgccgcccggcaccgccggcaacgaggacgtctgcccctgctacgcccacatgaccacgcacgacggccgccacaagtgcccatgattcaaccgccttctcgacggccggtcgaggctaatgcatactagatcatggcgtctcagtaaatatcccatcaagctagctacagccaacgataactagactaccaggggcacgatcgatatgatatcatgtactcaagctagtgctgctgcctatgtaccttgtgctcatccatccgtgatcgatccatcgtgtaagcatgtttgctatctcgttctcacgcagtggtaattgccgtcaattgcactaaaacaattagtgcgtatggtattgaatttatactccagccaactcatgtaaaagtctgaactgatgaagagaggcggacaatatatatctacaccattctccctcacgtctaggcttatttactccttagacgtaggatttgtctaggccgcataatcgtttttttaatactgcgttggtagggtctgatcacaagacctctcggctctgataccatattgaattcctgcttcagtcagtttattcaaaagtccgaactgatgaagaaagacg

SEQ ID NO: 416 - DNA, 415 bp, Triticum_aestivum
tacatgtgcaactaagaagcatggcttgtgtcgcacgcactctttccattcctttcttgcttgcattattcttcgtggctgaggtatccgggagcatgaacgtagaatcatacaaaccggctggtgcagaaggatctgttcctttaaaagaatgcccagcgaaatgcaagatccgttgctcagctacgtcacacaagaaaccatgcaatttctattgtaactactgctgcaagaggtgcctgtgtgttccgtccggcacggtgggcaacaaggaagaatgcccgtgctacaacaacttgaagacccaggatggcaagcctaagtgcccgtgatatgcctgcaagtcgtgtgtggcctccaagttttacagtcttgttgtatcgaacaaagtattgataataaagttgacttgttt

SEQ ID NO: 417 - DNA, 670 bp, Triticum_aestivum
tcggcacgaggactccagctccctactctcaaggctcaagctcacaccaaccagcaggcagcagcgctctgccagagccaagaacctcaagcacaccacaatgaagcttggccccaccgccaccactgtggctctcctccttgtcctcctcttagcgtcctcgtctctgcgtgccgccacggctggatcagcgttctgcgacggcaagtgcggggtgaggtgctccaaggcgagccggcacgacgactgcctcaagtactgcgggatatgctgcgccgagtgcaactgcgtgccgtcggggacggccggcaacaaggacgagtgcccctgctaccgcgacaagaccaccggccacggcgcgcgcaagaggcccaagtgcccatgatccaccaccaccctccagccaccctccgccgctgatggcgcctgcctagcatgtacctgaacttcatgcatccctatcaatcatgtcgtactatgtcgcggatcaccactatatattatatgcgtgtaaatcatgatcttgagcgtccggtgcatgatcctactgtgtgttgataatgcataatgctggcctagctactggtttgccggcaaaaatgtcgctgtgctgtaataatgaaccatcatgcatcagtaaagtttgtccagtaatttccttgttctaaaa

SEQ ID NO: 418 - DNA, 533 bp, Triticum_aestivum
  misc_feature (496)..(496): n is a, c, g, or t
cctgagcttctcccgacctttggtcaggcaaaggaggcggccaacaaggacgagcgatggtgaccaaggtcatctgcttcctggtgctcgcatccgtgctcctcgccgtcgcttttcccgtgtctgctctgcggcagcaggtgaagaagggcggcggcggtgaaggcggaggcggaggcagtgttagcggaagcggaggcggcaacctgaatccctgggagtgctcgcccaagtgcgggtcgcggtgctccaagacgcagtacaggaaggcctgcctcaccttatgcaacaagtgctgcgccaagtgcctctgcgtgccaccggggttctacggcaacaagggcgcctgcccctgctacaacaactgggaaaacaaggaaggagggcccaagtgcccctagaagatcaacgcagctcccgtccgccattgtcccccttctccgaatctggaacgtgttgttcatcttcgacaacccctaagcttggattttatacnagtataatgctagtgtccgccgttgcttaatctggaa

SEQ ID NO: 419 - DNA, 661 bp, Triticum_aestivum
ccacgcgtccgcgactggagcacgaggacactgacatggactgaaggagtagaaatcaaagtccacaattcacaccgctcctacccagccacgcacgcgcggagaagagaagcagcaagccccatggccaagatctccttcctcctcgtggcgctcctcgtcctcgccgtcgggttccccgtggaggtgatgggaggtgggggcggcggcggcggtggcggtggcggcggcaacctcaagccatgggagtgctcgtccaagtgctcgtcgcggtgctcggggacgcagtacaagaaggcgtgcctgacctactgcaacaagtgctgcgccacctgcctctgcgtgccgccgggcacctacggcaacaagggcgcctgcccctgctacaacaactggaagaccaaggagggaggccccaagtgcccctagattcttggttttcttcttcttcttcttcttcttctggggtgccagcttgcggttgatggctattcactgctctcccatgaagatgttactagatctgaattacgtatgtgataggcatttagtggcatgtgaattgccctcccagtttcctgtgtttctatcagtaagatgtggaaaaatggaggcgctcccacatgattttagtgggacactatcgagctgtattgttcct

SEQ ID NO: 420 - DNA, 490 bp, Triticum_aestivum
gggctgcaggtaattcggcacgagggctccctactctcaaggctcaagctcacaccaaccagcaggcagcagcgctctgccagagccaagaacctcaagcacaccacaatgaagcttggccccaccgccaccactgtggctctcctccttgtcctcctcttagcgtcctcgtctctgcgtgccgccacgggtggatcagcgttctgcgacggcaagtgcggggtgaggtgctccaaggcgagccggcacgacgactgcctcaagtactgcgggatatgctgcgccgagtgcaactgcgtgccgtcggggacggccggcaacaaggacgagtgcccctgctaccgcgacaagaccaccggccacggcgcgcgcaagaggcccaagtgcccatgatccaccaccaccctccagccaccctccgccgctgatggcgcctgcctagcatgtacctgaactttatgcatccctatcaatcatgtcgtactatgtc

SEQ ID NO: 421 - DNA, 419 bp, Triticum_aestivum
  misc_feature (318)..(318): n is a, c, g, or t
  misc_feature (332)..(332): n is a, c, g, or t
  misc_feature (371)..(371): n is a, c, g, or t
  misc_feature (384)..(384): n is a, c, g, or t
cctccagcctcctcctatcgtcaagctcacaccaaccagcaggagggctctgccagagcgaagcaaccaagaacaccacgatgaagaagcttcgcaccaccactctggctctccttctcctcctcgtcttcctagcagcctcgtccctccgtgccgccatggctgggtcagcgttctgcgacggcaagtgcggggtgaggtgctccaaggcgagccggcacgacgactgcctcaagtactgcgggatatgctgcgccgagtgcaactgcgtgccgtcggggaccgccggcaacaaggacgagtgcccctgctaccgcnacaagaacaacggncaaggggcgcgcaaagagggccaagtgcccaagattcgncaacaatctccangcatcgattctccaacgcccatggggtctaaacaa

SEQ ID NO: 422 - DNA, 463 bp, Triticum_aestivum
  misc_feature (337)..(337): n is a, c, g, or t
  misc_feature (426)..(426): n is a, c, g, or t
  misc_feature (463)..(463): n is a, c, g, or t
ctccagcctcctcctatcgtcaagctcacaccaaccagcaggagggctctgccagagccaagcaaccaagaacaccacgatgaagaagcttcgcaccaccactctggctctccttctcctcctcgtcttcctagcagcctcgtccctccgtgccgccatggctgggtcagcgttctgcgacggcaagtgcggggtgaggtgctccaaggcggggcggcacgacgactgcctcaagtactgcgggatatgctgcgccgagtgcaactgcgtgccgtcggggaccgccggcaacaaagacgagtgcccctgctaccgcgacaagaacaacgggcacggngcgcgcaaagaaggccaaatgcccatgattcgccaacactctccaagcatcgattctccaacggccatggggtctaaaaaacatattgncttgaagcttcatgcaaccctatctaatcaagttctn

SEQ ID NO: 423 - DNA, 711 bp, Triticum_aestivum
  misc_feature (1)..(1): n is a, c, g, or t
  misc_feature (11)..(12): n is a, c, g, or t
  misc_feature (111)..(111): n is a, c, g, or t
  misc_feature (145)..(146): n is a, c, g, or t
  misc_feature (149)..(149): n is a, c, g, or t
  misc_feature (152)..(152): n is a, c, g, or t
ncgcgggatanngcgtggtcgcgcccgaggtcagccacgcacgcgtggagaagagaaacagcaagcaccatggccaagatctccttcctcttcgtggcgctcctcgtcctngccgtcgcgttccccgtgaaggtgatgggagtgnncgncgncggcaagctcaagccatgggagtgcccgtccaagtgctcgtcgcggtgctcggggacgcagtacaagaaggcgtgcctgacctactgcaacaagtgctgcgccacctgcctctgcgtgccgccgggcacctacggcaacaagggcgcctgcccctgctacaacaactggaagaccaaggagggaggccccaagtgtccctagattcttgattttctttcttcttcttctggggtgccagcttgcggttcatggttattcactactcggccatcaagatgttactagatctgaattatgtgacaggcatttagtggcatgtgaattgccctaccaattatccgtgtttctatcagtaggactaagatgtggaaaaatggaggcgctcccacatgattatagtgggacctctcgagctttattgttccttgtgcgcctgtgcaccgtgctttcttcttgtctcaaaagtcagatgaagcatgaagcgcccgtaccattcggcatgaatgatgagctaccacaatgaacaaaagcatgcaacacctcggccgcgaccacgct

SEQ ID NO: 424 - DNA, 685 bp, Triticum_aestivum
cagctccctagcctcaagctcacacggtcacaccaaccagcagggctctgccactgccagagccaagcaactcaagaacagtagaacaccacgatgaagaagcttcgcaccaccaccgccaccaccactctcgctctcattctcctcctcgtcctcatagcagccacgtccctccgtgtcgccatggctggatcagcgttctgcgacagcaagtgcggggtgaggtgctccaagacgggccggcacgacgactgcctcaagtactgcgggatatgctgcgccgagtgcaactgcgtgccgtcggggacagccggcaacaaggacgagtgcccctgctaccgcgacaagaccaccggccacggcgcgcgcacgaggcccaagtgcccatgatccgccaccgcccatggcgcctgcatagcatgtacctgaacttcatgcatctttatcatgtcgtactatgtcgcgggtcactactattatattatactatatgcgtgtaaatcatgatctgaagcgtccggtgcatgatccgactgtatgttgataatgcgtaatgctggcctactggtatgccggtaaaaatgtcgttgttctgtaataataaactacatgcattattagagtctgtcaagtaaatttccttgttctgtttctgtttcctttgggtaaagtaaaatttacatgg

SEQ ID NO: 425 - DNA, 672 bp, Triticum_aestivum
  misc_feature (659)..(659): n is a, c, g, or t
ggtttcttccacatttccactgagcaaagagaagcaaatcggcagagagcgaagcaaaccggcggttcctggcccctcgccatggccggcaaagctagggtgttcatgtgcgtggcgctcgtcgtcctcctgctccttgtcgagaccaccgctccgagtggacaagctcacgccgtcgattgcggcagcgcgtgctcgtaccggtgcagcaagtcgagccggccgaatctgtgcaacagggcgtgcaacacgtgctgccggcgatgcgactgcgtgccgcccggcaccgccggcaacgaggacgtctgcccctgctacgcccacatgaccacgcacgacggccgccacaagtgcccatgatccaaccgccttctcgacgaccgatcgaggctaatgcatgctcgatcatggcgtctcagttaatatcccatcaagctagctacaaccaacgataactagactaccagtggcacgatcgatatgatatcatgtactcaagctagtgctgctacctatctaccttgtgctcatccattcgtgattgatccatcgtgtaagcatgtttgctatctcattctcacgcagtggtaattgctgtcaattgcactaaaacaattagtactcatggtattgtattcatacttcagccaactcatatnaaagtctgaactg

SEQ ID NO: 426 - DNA, 603 bp, Triticum_aestivum
ctcgagtcgcgcgctcggcgttgcatcttcacctctgctcagctaaataagtggctgcttttgccaaacatctcttggacggaaacagagttgaagaagaaagacaaggcgatgaagcctctcccggtgaccctggctctcctggccctcttcctcgtcgcctcgtaccaggacctcaccgtggccgcagatgcagatgcagatgcagctggagctggagatgttggcgccgttccggttccggacagcgtgtgcgagggcaagtgcaagaaccggtgctcgcagaaggtggccgggcggtgcatggggctgtgcatgatgtgctgcggcaagtgcgccggctgcgtgccgtcggggccgttggcccccaaggacgagtgcccctgctaccgcgacatgaaatcccccaagagcggccgccccaaatgcccctaggactagggcgcttctttttctttcttgggtggaatgggatcttgacgagccgggtgcgtgggatttaggggttccccttgtttgtaagcttgatttgttcgggataaacaacgcagatccggtttgagtagcgaggagtgaggagtgcttccatgtcttctcgcatct

SEQ ID NO: 427 - DNA, 1442 bp, Triticum_aestivum
caccatttcagagcgcgagctcgagctagcacccatggcgccgggcaagcagcttctccctcctctgcttctgctgatgctcctccaccatcagcctgccgccggcgcttccgatccaccggtgacccacggcggcatgcgagccagcaccgccaggtcccttctccagcagcagcagcagcagcagcctcccaggctagactgccccaaggtgtgcctggggcggtgcgccaacaactggaggaacgagatgtgcaacgacaagtgcaacgtctgctgccagcgctgcaactgcgtgccgcccggcaccggccaggacacccgccacatctgcccctgctacgaccgcatgaccaacccgcacaacggcaagctcaagtgcccctagaggcctagacacaacactttgacccggagaaatcatcttcttcacatgtgtcttctgtcatgcatcttctttccactagtatgtgctgtatgtgatcttcacacagcgctctgccactgttcccactctcagggaacaatgctctgggatcttatcatagtcatagcataaataaaagatgcctgccttgttgctggccagatctagttacagtatcccataagctaagataagagttacacacagccagtgttgggttgcattgcagttgcagacatgagtgatcccttctcattctcactgaatgacgatgatttcctgcattgttggtgatcagatctatattatgcagctacagagttagatagatacagtgccgagttgagttacaggcatatatgtacacacaccacatgggtgagcaagctaattagatttaaaaaggggttgcacctatgatatcaaccccaactagtaagtaagcagtgagctaaacattttctggtctggtttcactttcaattgagcagcacctccacatgtacctctatctcaaatatatacaggggtaacacaggcggacggcgccgctcagtccggatggttctggttacaggggaagtggcccccgtcagtgttctgaaacatggtgtgtgcaaaaagcttggggtcgtctaccgttgctgtcgggacaggaagaactcatagtccgggtgcctgttcctgtgggcctggtccttcttccacacgtccgccctggccatggccgccgcggcttggttcagcgtcgacaacctttcttcaagaacctgagatggttcacttgacgaggactctgagtcttccgaaccggatctgctcgtctgaaaccaccactcccccttgtcgttgtaagattgcaaacctatgactggcaaaacagcattacaatggccagcctgatctgctgagtttcctcgatgaacccagtgtccaagagaatggtacgtcaggaaagcagcctggaatttcccgtcaggtatacggtatatgggataccacgcgacacagtacc

SEQ ID NO: 428 - DNA, 612 bp, Triticum_aestivum
ccacgcgtccgcggacgcgtgggcaagctcacaccaaccagcagggctgggctctgccagagccaagcaactcaagaacaccacgatgaagaagcttcacaccaccaccgccaccaccactctggctctccttctcctcctcgtcctcctagcagccacgtccctccgtgtcgccatggctggatcagcgttttgcgacagcaagtgcggggtgaggtgctccaaggcgagccggcacgacgactgcctcaagtactgcgggatatgctgcgccgagtgcaactgcgtgccgtcggggaccgccggcaacaaggacgagtgcccgtgctaccgcgacaagaccaccggccacggcgcgcgcacgaggcccaagtgcccatgatccatgcaccacccatggcgtctacatggggcatatacctacctgaactggaagatgccctatcatgtactgtacttagtaccatgtcgcggatcactactatattatatgcgtgtaatcatgatctgaaacgcctggttcatgatccgactgtatgttgataatgcatattgctggcctactggtatgccggtaacactgtcattgtgctgtaactatacactatcatg

SEQ ID NO: 429 - DNA, 623 bp, Triticum_aestivum
acctctcaagtccacaattcacatcgctcttacccagccacacgcggagaagagacccagcaagcgccatggccaagatctccttcctcctcgtggcgctcctcgtcctcgccgtcgcgttccccgtggaggtgatgggaggcggcaacggcggcgccggcggcggcggcaagctcaagccatgggagtgctcgtccaagtgctcgtcgcggtgctcggggacgcagtacaagaaggcgtgcctgacctactgcaacaagtgctgcgccacttgcctctgcgtgccgccgggcacctacggcaacaagggcgcctgcccctgctacaacaactggaagaccaaggagggaggccccaagtgcccctagattcttgattttctttcttcttcttctggggtgccagcttgcggttgatggttattcactgctcggccatcaaaatgtactacagtagatctgaattatgtgatgggcatttaatcagtggcatgtgaattgccctcccagttacctgtatttctatcagtaagatgtggaaaactggaggcactccgccactcccacatgattatagtgggacctatcgagctttattgttccttgtgcgcctgtgcaccgtgc

SEQ ID NO: 430 - DNA, 581 bp, Triticum_aestivum
ctcaagccagcatccatggcgccgacccagcagcggcttctcactcgtcgccgtctccttcctcctctgctgctgttgctcctcctcgccgcacatcttcagcctgctgctgcttcctcttctgcttctgatccgctggtgaccaccacgacggcccacggcagcatgagggccagcagcaggtccctgctccagcagcagccgcctcccagactagactgccccaaggtgtgcttgggccgctgcgccaacaactggaagaacgagatgtgcaacgacaagtgcaacgtctgctgccagcgctgcaactgcgtgccccccggcaccggccaggacacccgccacatctgcccctgctacgaccaaatgaccaacccgcacaacggcaagctcaagtgcccttgatctagagcacatcatcttcagatgtgtcttctgtcatgcatgttctactgttcccaccctcagggagtaatggcctgtgatcttatcaaagcataaataagaagagagagtttctatctgttggttccctgcctgccttgttgctggccagatccagttatagtattccataagct

SEQ ID NO: 431 - DNA, 570 bp, Oryza sativa
gtacaaaaaagcaggcttaaacaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgcctcctcactctcacctagaaaacatggcaaggaatagagagaggttacccagcttt

SEQ ID NO: 432 - protein, 175 aa, Oryza sativa
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHASSLSPRKHGKE

SEQ ID NO: 433 - DNA, 528 bp, Arabidopsis thaliana
atggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatag

SEQ ID NO: 434 - protein, 175 aa, Arabidopsis thaliana
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 435 - DNA, 786 bp, Arabidopsis thaliana
atgaatggtttgcaagaagtttgttcgtcaagtgggtcggtgatgatcggactaccagctgaagaagacgaaaacgccgcacattcgtcggaggattcatcttgccccgacgagtcagtgtcagagacagagctcgacctagctttgggtcttagcattggtcgtcggaaggttcgatcgtctttgtcttcctcgtcttcttctctgaccagggaaagtgggaccaaacgctctgctgattcttctccggctgccgcctcaaacgcaaccagacaagttgctgtaggttggccgcctctacggacttacagaatcaacagtttggtcaatcaagcaaagtctttagctacggaaggcggcttgagttctggcattcaaaaggagactacaaaaagtgtagtggttgctgctaagaacgatgatgcttgctttatcaaatcgtccaggacttctatgcttgtgaaggtgacaatggacggagttataattggaaggaaggttgatctcaatgctctggattcttatgcagccttagagaaaactttggatctaatgtttttccagattccttctcctgtaacaagatccaacacacaaggatacaagacaattaaggaaacatgtacttcgaaattactggatggctcatcggaatatatcataacatatcaagataaagacggagattggatgcttgtaggagatgttccttggcagatgttcctcgggtctgtgacaagactgagaatcatgaagacatcaattggagctggagtaggtaagtag

SEQ ID NO: 436 - protein, 261 aa, Arabidopsis thaliana
MNGLQEVCSSSGSVMIGLPAEEDENAAHSSEDSSCPDESVSETELDLALGLSIGRRKVRSSLSSSSSSLTRESGTKRSADSSPAAASNATRQVAVGWPPLRTYRINSLVNQAKSLATEGGLSSGIQKETTKSVVVAAKNDDACFIKSSRTSMLVKVTMDGVIIGRKVDLNALDSYAALEKTLDLMFFQIPSPVTRSNTQGYKTIKETCTSKLLDGSSEYIITYQDKDGDWMLVGDVPWQMFLGSVTRLRIMKTSIGAGVGK

SEQ ID NO: 437 - DNA, 570 bp, Arabidopsis thaliana
atggatgagtttgttaacctcaaggaaacagagctgaggctgggattaccgggaacagataatgtatgtgaagcaaaagagagagtttcttgctgtaataacaacaataagagagtactatcaactgatactgagaaggagattgaatcatcatcaaggaaaactgaaacatcccctcctcgaaaggctcagattgttggatggccaccagttagatcttacaggaagaacaacattcagagtaagaagaatgaatctgagcatgagggtcaaggaatctatgtgaaagtaagtatggatggtgcaccatacttgaggaaaatagatctgagttgttacaaaggatactcagagttgcttaaagctttagaagtgatgttcaaattctctgtgggagagtactttgagagagatggatataaaggttcagactttgtgcctacttatgaagacaaagatggtgattggatgctcattggtgatgttccatgggagatgttcatatgtacgtgcaagagactaaggatcatgaaaggatcagaagccaaaggtttaggctgtggtgtatga

SEQ ID NO: 438 - protein, 189 aa, Arabidopsis thaliana
MDEFVNLKETELRLGLPGTDNVCEAKERVSCCNNNNKRVLSTDTEKEIESSSRKTETSPPRKAQIVGWPPVRSYRKNNIQSKKNESEHEGQGIYVKVSMDGAPYLRKIDLSCYKGYSELLKALEVMFKFSVGEYFERDGYKGSDFVPTYEDKDGDWMLIGDVPWEMFICTCKRLRIMKGSEAKGLGCGV

SEQ ID NO: 439 - DNA, 690 bp, Arabidopsis thaliana
atgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttga

SEQ ID NO: 440 - protein, 229 aa, Arabidopsis thaliana
MMGSVELNLRETELCLGLPGGDTVAPVTGNKRGFSETVDLKLNLNNEPANKEGSTTHDVVTFDSKEKSACPKDPAKPPAKAQVVGWPPVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 441 - DNA, 522 bp, Arabidopsis thaliana
atgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtctgtactgttttcaaatgcgtacactataa

SEQ ID NO: 442 - protein, 173 aa, Arabidopsis thaliana
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGLYCFQMRTL

SEQ ID NO: 443 - DNA, 720 bp, Arabidopsis thaliana
atgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttag

SEQ ID NO: 444 - protein, 239 aa, Arabidopsis thaliana
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGTTCREKVKPLRLLDGSSDFVLTYEDKEGDWMLVGDVPWRMFINSVKRLRIMGTSEASGLAPRRQEQKDRQRNNPV

SEQ ID NO: 445 - DNA, 558 bp, Arabidopsis thaliana
atgtattgcagcgatcctccccatcccttgcacttagtggcatcagacaaacaacaaaaagaccacaaactgatcctttcctggaagaaaccaacaatggactcagacccactcggtgttttcccaaattctcccaagtatcatccatattactcgcagaccacggagtttggtggcgtaatcgatttaggtctcagcctgagaaccatacaacatgagatttaccactcatctggccaaagatattgtagtaatgaaggatacagacggaagtggggttatgtaaaggtcaccatggatggtttggtggtaggtcgcaaggtctgtgttcttgatcatggaagctattcaactcttgctcatcaactcgaggacatgtttgggatgcagagtgtgtcgggattgaggttgttccagatggagtctgagttctgtttggtctacagagacgaagaaggtctgtggagaaatgctggggatgttccatggaatgagttcatagaaagcgtggagcggctgagaatcacaagaagaaacgatgctgtacttcccttttaa

SEQ ID NO: 446 - protein, 185 aa, Arabidopsis thaliana
MYCSDPPHPLHLVASDKQQKDHKLILSWKKPTMDSDPLGVFPNSPKYHPYYSQTTEFGGVIDLGLSLRTIQHEIYHSSGQRYCSNEGYRRKWGYVKVTMDGLVVGRKVCVLDHGSYSTLAHQLEDMFGMQSVSGLRLFQMESEFCLVYRDEEGLWRNAGDVPWNEFIESVERLRITRRNDAVLPF

SEQ ID NO: 447 - DNA, 492 bp, Arabidopsis thaliana
atggcgaatgagagtaataatcttggactcgaaatcaccgaactacggctaggtcttcccggagatatcgtcgtctccggtgagtccatctccgggaagaagagggcttctccggaagtagagattgatttgaaatgtgaaccggcgaaaaagagtcaagttgtgggttggccaccggtttgttcgtaccggagaaagaacagtctcgaacggaccaaaagttcgtacgtgaaagtgagtgtagatggagctgcatttttaaggaagattgatttggaaatgtacaaatgttaccaagatcttgcttccgctctgcaaattctgttcggatgctatatcaattttgatgatacgttgaaggaaagtgaatgtgtaccaatatatgaagacaaagatggagattggatgcttgctggagatgttccttgggaaatgttccttggatcgtgcaagaggttaaggattatgaagagatcatgtaacagaggatga

SEQ ID NO: 448 - protein, 163 aa, Arabidopsis thaliana
MANESNNLGLEITELRLGLPGDIVVSGESISGKKRASPEVEIDLKCEPAKKSQVVGWPPVCSYRRKNSLERTKSSYVKVSVDGAAFLRKIDLEMYKCYQDLASALQILFGCYINFDDTLKESECVPIYEDKDGDWMLAGDVPWEMFLGSCKRLRIMKRSCNRG

SEQ ID NO: 449 - DNA, 804 bp, Arabidopsis thaliana
atggagggttattcaagaaacggtgaaatctctccgaagctgcttgacttgatgattccacaagagagaagaaattggtttcacgatgagaaaaactctgttttcaaaacagaggagaagaagcttgagctaaagcttggaccacctggtgaagaagatgatgatgaatcgatgataagacacatgaagaaagaaccaaaagacaaatctatcctctctctcgctggcaaatacttctctccttcttccaccaaaaccacatcccataaaagaactgctcctggtccagtggtgggatggcctccggttcgatccttcaggaagaatttagctagtggaagttcttcaaagcttggaaatgactcaaccacctccaatggtgttaccctcaagaaccaaaagtgtgatgctgctgctaagacaacagaaccaaagagacaaggaggcatgtttgtgaagatcaacatgtatggtgttcccattggtcgtaaagttgatctcagtgctcataatagctatgagcagttatctttcacagttgacaagctcttcagaggtcttcttgcagctcaaagagactttccatcatccatagaagatgaaaaaccaatcactggattattagatgggaatggagaatatactcttacatatgaagacaatgaaggagacaagatgcttgtaggagatgttccatggcaaatgtttgtgtcttcggtgaagaggctgcgtgtgattaaaacttctgagatttcttcagcattaacatatggaaatggtaagcaagagaaaatgagaagatga

SEQ ID NO: 450 - protein, 267 aa, Arabidopsis thaliana
MEGYSRNGEISPKLLDLMIPQERRNWFHDEKNSVFKTEEKKLELKLGPPGEEDDDESMIRHMKKEPKDKSILSLAGKYFSPSSTKTTSHKRTAPGPVVGWPPVRSFRKNLASGSSSKLGNDSTTSNGVTLKNQKCDAAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 451 - DNA, 570 bp, Arabidopsis thaliana
atggcaaaggaaggtctagcactcgagatcacagagcttcgattgggtcttccaggagataattatagcgaaatatcagtatgcggatcgagtaagaagaagaagagggtgctctcggatatgatgacctcatcagcgttagatactgagaatgaaaacagcgtcgtttcatcagttgaagatgaatcactgccggttgtgaagagtcaagcggtgggatggccacctgtgtgttcttacaggagaaagaagaacaatgaggaagcatcgaaagctataggctacgtgaaagtgagcatggatggtgtgccatacatgaggaagattgaccttggttcgagcaacagttatattaatctagtcacggttcttgagaatctcttcggctgtcttggcataggagtggcgaaggagggtaagaagtgtgaatacattattatatacgaagacaaggatagagactggatgctcgtcggagatgtaccttggcagatgtttaaagaatcatgcaagaggctgaggatcgtgaagagatcagatgcaactggttttggtctccagcaagattaa

SEQ ID NO: 452 - protein, 189 aa, Arabidopsis thaliana
MAKEGLALEITELRLGLPGDNYSEISVCGSSKKKKRVLSDMMTSSALDTENENSVVSSVEDESLPVVKSQAVGWPPVCSYRRKKNNEEASKAIGYVKVSMDGVPYMRKIDLGSSNSYINLVTVLENLFGCLGIGVAKEGKKCEYIIIYEDKDRDWMLVGDVPWQMFKESCKRLRIVKRSDATGFGLQQD

SEQ ID NO: 453 - DNA, 540 bp, Arabidopsis thaliana
atgtcaccggaggaatacgttagggtttggccggattccggtgatcttggaggaactgagctgaccctagctttgcctggcactccgacaaatgcatcggaaggtccaaaaaagttcgggaacaaacgtagattcctcgagaccgttgatttaaaactcggggaagcacacgagaacaattatatctcaagcatggtcactaatgaccagttggtgggctggccgccggtagcgacagcgaggaaaacagtgaggcggaaatacgtgaaagtggcgttggatggtgcggcctatctcagaaaggttgatcttgggatgtacgattgctatggacagcttttcaccgctctagaaaacatgtttcaggggataataacaatatgtagagtgacagagttggagaggaagggagagtttgttgctacttacgaggataaggacggtgacttgatgttagtcggagatgtgccgtggatgatgtttgtggaatcttgcaaacgtatgaggttaatgaaaaccggagatgctattggattatag

SEQ ID NO: 454 - protein, 179 aa, Arabidopsis thaliana
MSPEEYVRVWPDSGDLGGTELTLALPGTPTNASEGPKKFGNKRRFLETVDLKLGEAHENNYISSMVTNDQLVGWPPVATARKTVRRKYVKVALDGAAYLRKVDLGMYDCYGQLFTALENMFQGIITICRVTELERKGEFVATYEDKDGDLMLVGDVPWMMFVESCKRMRLMKTGDAIGL

SEQ ID NO: 455 - DNA, 576 bp, Arabidopsis thaliana
atggacccaaacacacctgcagacttcttcaaaggttcttccaagtttcatacatattactcacagaccaaaaagggtggtggggtaatcgatctaggcctcagccttaggaccatacaacatgaaacttacctcccaccggcgcgaatgataggtctcgacgggtatggagagctcatagactggtcgcagcccagctataacagcattacacagttgaagagtgaggacactggacaccaaagacttgcccaaggatattacaataatgaaggagagagcagaggaaaatatgcttacgtaaaggtaaatctggatggcctagtggtagggcgcaaggtttgccttgttgatcaaggagcttacgcaactcttgctcttcagctcaatgatatgtttgggatgcagaccgtgtcgggattgaggttgttccagactgagtctgagttctctttggtctacagagacagagaaggcatttggaggaatgttggggatgttccatggaaggagtttgtcgaaagcgtggatcggatgcgaatcgcaagaagaaacgatgctcttcttcccttttaa

SEQ ID NO: 456 - protein, 191 aa, Arabidopsis thaliana
MDPNTPADFFKGSSKFHTYYSQTKKGGGVIDLGLSLRTIQHETYLPPARMIGLDGYGELIDWSQPSYNSITQLKSEDTGHQRLAQGYYNNEGESRGKYAYVKVNLDGLVVGRKVCLVDQGAYATLALQLNDMFGMQTVSGLRLFQTESEFSLVYRDREGIWRNVGDVPWKEFVESVDRMRIARRNDALLPF

SEQ ID NO: 457 - DNA, 966 bp, Arabidopsis thaliana
atgtcttatcgattgctaagtgtggataaggatgaactggttacgtcaccttgtttgaaagaacgtaactacttgggtctctctgattgttcctctgttgatagctcaactattcccaatgttgttgggaagagcaatctcaatttcaaagctactgaactgaggctaggtcttcctgagtctcaatctcctgagagagagactgatttcggtttgctgagtccgagaacacccgatgagaagcttctcttcccgttgctaccttctaaagacaatggttctgctactacagggcataagaatgttgtttctggtaacaagagaggatttgctgacacttgggatgagttttcgggtgtgaaaggatctgttagacctggaggaggaatcaacatgatgttgtcgccgaaagttaaggatgtctcgaagagtattcaagaagaaagatctcatgctaagggtggcttgaacaatgcaccagctgccaaggcacaggttgttggttggcctccaatcagatcataccggaagaatacaatggcttcttctacttcgaagaacactgatgaggttgatgggaaacctggtcttggtgttctgtttgtgaaggtgagcatggatggtgctccgtatctgagaaaggtcgacttgagaacttacacttcctatcaacagttgtcttctgcacttgagaaaatgttcagctgcttcacccttggtcaatgtggtcttcatggtgctcaagggagggaaagaatgagcgagattaaactgaaggatcttcttcatggatcagaatttgtgcttacttatgaagataaagacggtgattggatgcttgttggcgatgttccatgggagatatttactgaaacatgccagaaactgaagatcatgaagggttctgattctattggcttagctccaggtgcagtggagaaatcgaagaacaaagagcgggtttga

SEQ ID NO: 458 - protein, 321 aa, Arabidopsis thaliana
MSYRLLSVDKDELVTSPCLKERNYLGLSDCSSVDSSTIPNVVGKSNLNFKATELRLGLPESQSPERETDFGLLSPRTPDEKLLFPLLPSKDNGSATTGHKNVVSGNKRGFADTWDEFSGVKGSVRPGGGINMMLSPKVKDVSKSIQEERSHAKGGLNNAPAAKAQVVGWPPIRSYRKNTMASSTSKNTDEVDGKPGLGVLFVKVSMDGAPYLRKVDLRTYTSYQQLSSALEKMFSCFTLGQCGLHGAQGRERMSEIKLKDLLHGSEFVLTYEDKDGDWMLVGDVPWEIFTETCQKLKIMKGSDSIGLAPGAVEKSKNKERV

SEQ ID NO: 459 - DNA, 960 bp, Arabidopsis thaliana
atgtcttatcgattgctaagtgtggataaggatgaactggttacgtcaccttgtttgaaagaacgtaactacttgggtctctctgattgttcctctgttgatagctcaactattcccaatgttgttgggaagagcaatctcaatttcaaagctactgaactgaggctaggtcttcctgagtctcaatctcctgagagagagactgatttcggtttgctgagtccgagaacacccgatgagaagcttctcttcccgttgctaccttctaaagacaatggttctgctactacagggcataagaatgttgtttctggtaacaagagaggatttgctgacacttgggatgagttttcgggtgtgaaaggatctgttagacctggaggaggaatcaacatgatgttgtcgccgaaagttaaggatgtctcgaagagtattcaagaagaaagatctcatgctaagggtggcttgaacaatgcaccagctgccaaggcacaggttgttggttggcctccaatcagatcataccggaagaatacaatggcttcttctacttcgaagaacactgatgaggttgatgggaaacctggtcttggtgttctgtttgtgaaggtgagcatggatggtgctccgtatctgagaaaggtcgacttgagaacttacacttcctatcaacagttgtcttctgcacttgagaaaatgttcagctgcttcacccttggtcaatgtggtcttcatggtgctcaagggagggaaagaatgagcgagattaaactgaaggatcttcttcatggatcagaatttgtgcttacttatgaagataaagacggtgattggatgcttgttggcgatgttccatgggagatatttactgaaacatgccagaaactgaagatcatgaagggttctgattctattggcttaggtgcagtggagaaatcgaagaacaaagagcgggtttga

SEQ ID NO: 460 - protein, 319 aa, Arabidopsis thaliana
MSYRLLSVDKDELVTSPCLKERNYLGLSDCSSVDSSTIPNVVGKSNLNFKATELRLGLPESQSPERETDFGLLSPRTPDEKLLFPLLPSKDNGSATTGHKNVVSGNKRGFADTWDEFSGVKGSVRPGGGINMMLSPKVKDVSKSIQEERSHAKGGLNNAPAAKAQVVGWPPIRSYRKNTMASSTSKNTDEVDGKPGLGVLFVKVSMDGAPYLRKVDLRTYTSYQQLSSALEKMFSCFTLGQCGLHGAQGRERMSEIKLKDLLHGSEFVLTYEDKDGDWMLVGDVPWEIFTETCQKLKIMKGSDSIGLGAVEKSKNKERV

SEQ ID NO: 461 - DNA, 741 bp, Arabidopsis thaliana
atgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggctaaggattttccttctgttggttctaaacgtgctgctgattctgcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttag

SEQ ID NO: 462 - protein, 246 aa, Arabidopsis thaliana
MITELEMGKGESELELGLGLSLGGGTAAKIGKSGGGGAWGERGRLLTAKDFPSVGSKRAADSASHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 463 - DNA, 744 bp, Arabidopsis thaliana
atgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggctaaggattttccttctgttggttctaaacgtgctgctgattctgcttctcatgctggttcatctcctcctcgttcaagcagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttag

SEQ ID NO: 464 - protein, 247 aa, Arabidopsis thaliana
MITELEMGKGESELELGLGLSLGGGTAAKIGKSGGGGAWGERGRLLTAKDFPSVGSKRAADSASHAGSSPPRSSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 465 - DNA, 528 bp, Arabidopsis thaliana
atgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactga

SEQ ID NO: 466 - protein, 175 aa, Arabidopsis thaliana
MGRGRSSSSSSIESSSKSNPFGASSSTRNLSTDLRLGLSFGTSSGTQYFNGGYGYSVAAPAVEDAEYVAAVEEEEENECNSVGSFYVKVNMEGVPIGRKIDLMSLNGYRDLIRTLDFMFNASILWAEEEDMCNEKSHVLTYADKEGDWMMVGDVPWEMFLSTVRRLKISRANYHY

SEQ ID NO: 467 - DNA, 711 bp, Arabidopsis thaliana
atgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttga

SEQ ID NO: 468 - protein, 236 aa, Arabidopsis thaliana
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 469 - DNA, 594 bp, Arabidopsis thaliana
atggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtggggttagggtatgtgaaagtgagcatggatggtgtgccttatttgaggaagatggatcttggttcgagccaaggctatgatgatctagcctttgctcttgataagctcttcggtttccgtggcatcggtgtggccttgaaagatggtgacaactgcgaatacgttaccatatacgaagacaaagatggagactggatgctcgccggtgatgtaccttgggggatgtttctagagtcatgcaagaggttgagaataatgaaaagatcggatgctaccgggtttgggctgcagcctagaggagtagacgagtga

SEQ ID NO: 470 - protein, 197 aa, Arabidopsis thaliana
MEKEGLGLEITELRLGLPGRDVAEKMMKKRAFTEMNMTSSGSNSDQCESGVVSSGGDAEKVNDSPAAKSQVVGWPPVCSYRKKNSCKEASTTKVGLGYVKVSMDGVPYLRKMDLGSSQGYDDLAFALDKLFGFRGIGVALKDGDNCEYVTIYEDKDGDWMLAGDVPWGMFLESCKRLRIMKRSDATGFGLQPRGVDE

SEQ ID NO: 471 - DNA, 810 bp, Arabidopsis thaliana
atggaaggttgtccaagaaacagagaaatcggtccaaaacttcttgatttgattccacaaggaaggaaatggtaccaagaagacaagaacaacacagatcaggagaagaaacttgagctaaggcttggaccacccggtggtgatgaagaagatcattcagcaatcaagaagaagaacacagagataagaaacatcaagaaggaaacagaagacaaatctttccactgttttaatggcaatcacttctctccttccaacaaaaccacttctgttcctcacatctcacagaaaagaactgctcctggtccagtggtgggttggcctccggttcgttcgttcagaaagaatctagcgagcacaagctcttcaaagctaggtaacgaatcctctcatggaggtcaaatcaacaagagtgatgatggtgaaaaacaagttgaaaccaagaaggaaggaatgtttgtcaagatcaacatggatggtgttcctattggtcgtaaagttgatctcaatgcttacaacagctacgaacagctctcttttgtcgttgacaaactcttcagaggtctactcgcagctcaaagagatatctctgatggtcaaggagaagagaaacctatcattggattattagatgggaaaggagaatttactttaacctatgaagacaatgaaggggacaagatgcttgttggggatgttccatggcaaatgtttgtttcatctgtgaagagactgcgtgtgattaaaagctctgagatttcatctgccttgacatttggatgcagtaagcaagagaagatgatgcactga

SEQ ID NO: 472 - protein, 269 aa, Arabidopsis thaliana
MEGCPRNREIGPKLLDLIPQGRKWYQEDKNNTDQEKKLELRLGPPGGDEEDHSAIKKKNTEIRNIKKETEDKSFHCFNGNHFSPSNKTTSVPHISQKRTAPGPVVGWPPVRSFRKNLASTSSSKLGNESSHGGQINKSDDGEKQVETKKEGMFVKINMDGVPIGRKVDLNAYNSYEQLSFVVDKLFRGLLAAQRDISDGQGEEKPIIGLLDGKGEFTLTYEDNEGDKMLVGDVPWQMFVSSVKRLRVIKSSEISSALTFGCSKQEKMMH

SEQ ID NO: 473 - DNA, 477 bp, Arabidopsis thaliana
atggaggtctctaactcttgttcttcattttcttcatcctctgtcgacagtactaaaccttctccttctgaatcttctgttaatctctcccttagtctcacatttccttctacttctccacaaagagaagcaagacaagattggccaccgataaagtctagattaagagatacactaaagggtcgtcgtcttcttcgtcgtggtgatgacacttctctctttgttaaggtttatatggaaggtgttcccattggaagaaaactcgacctttgcgtattctcaggctacgagagtctattagaaaatctctctcacatgttcgatacttcaatcatctgcggtaatcgagatcgaaaacatcatgttttgacatatgaagacaaggatggagattggatgatggtcggagatattccatgggatatgtttcttgaaaccgtgagaagactaaagatcacgagaccggagaggtattaa

SEQ ID NO: 474 - protein, 158 aa, Arabidopsis thaliana
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWDMFLETVRRLKITRPERY

SEQ ID NO: 475 - DNA, 525 bp, Arabidopsis thaliana
atggcgtacgagaaagtcaacgagcttaaccttaaggacacagagctatgtcttggattacccggaagaacagagaagatcaaagaagaacaagaggtttcttgcgttaaaagtaacaacaagcgtctatttgaggaaactcgtgatgaagaagaatctacacctcctaccaaaactcaaatcgttggttggccaccagtgagatcttcccgtaagaacaacaacagtgtgagctacgtgaaagtgagtatggacggagctccttaccttcgcaagatcgatctcaagacatacaaaaactaccccgagcttctcaaagcgttagagaatatgttcaaagtcatgattggtgaatattgtgagagagaaggatacaaaggatctggatttgtaccaacatacgaagataaagatggtgactggatgttggttggtgatgttccatgggacatgttctcttcttcttgtaagagactcagaatcatgaagggatccgacgctcctgctctagactcttccttatga

SEQ ID NO: 476 - protein, 174 aa, Arabidopsis thaliana
MAYEKVNELNLKDTELCLGLPGRTEKIKEEQEVSCVKSNNKRLFEETRDEEESTPPTKTQIVGWPPVRSSRKNNNSVSYVKVSMDGAPYLRKIDLKTYKNYPELLKALENMFKVMIGEYCEREGYKGSGFVPTYEDKDGDWMLVGDVPWDMFSSSCKRLRIMKGSDAPALDSSL

SEQ ID NO: 477 - DNA, 732 bp, Arabidopsis thaliana
atgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttga

SEQ ID NO: 478 - protein, 243 aa, Arabidopsis thaliana
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 479 - DNA, 633 bp, Arabidopsis thaliana
atgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggagtga

SEQ ID NO: 480 - protein, 210 aa, Arabidopsis thaliana
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWE

SEQ ID NO: 481 - DNA, 519 bp, Arabidopsis thaliana
atgggaagagggagaagctcatcgtcttcatcgatagagagcagctgcaaaagcaacccatttggtgtgtcttcgagtaatactcggaacctaagcacggacctgagactcgggctcagcttcggatcatcttccggacaatattacaacggtggagataaccatgaatatgatggagtcggtgcggcagaggaaatgatgatcatggaagaagaagagcaaaacgagtgtaatagtgtcggaagcttctacgtgaaagtgaacatggaaggagttcctattgggagaaagatcgatcttttatctcttaatggatatcatgatttgatcacaactctcgactacatgttcaatgcttcaatcctttgggctgaagaagaagatatgtgtagtgagaagagtcacgtgctaacgtacgcagacaaagaaggtgactggatgatggttggagatgttccttgggagatgttcttgtctagcgtgagaagactaaagatctcaagagcttatcactactga

SEQ ID NO: 482 - protein, 172 aa, Arabidopsis thaliana
MGRGRSSSSSSIESSCKSNPFGVSSSNTRNLSTDLRLGLSFGSSSGQYYNGGDNHEYDGVGAAEEMMIMEEEEQNECNSVGSFYVKVNMEGVPIGRKIDLLSLNGYHDLITTLDYMFNASILWAEEEDMCSEKSHVLTYADKEGDWMMVGDVPWEMFLSSVRRLKISRAYHY

SEQ ID NO: 483 - DNA, 687 bp, Arabidopsis thaliana
atgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatga

SEQ ID NO: 484 - protein, 228 aa, Arabidopsis thaliana
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 485 - DNA, 507 bp, Arabidopsis thaliana
atggaagtcaccaatgggcttaaccttaaggacacagagcttcgtttgggattacccggagcacaagaagaacaacaactagaactttcttgcgtcagaagcaacaacaagcgcaagaacaacgactcaacagaagaatctgctcctcctcctgcaaaaacacaaatcgttggatggcctccagtgagatctaaccgtaagaacaacaacaacaaaaacgtgagttatgtgaaagtgagtatggacggagctccatatctccgtaagatagatctcaagatgtacaaaaactatccagagcttctcaaagcactagagaacatgttcaagttcacagtaggtgaatattccgagagagaaggctacaaaggatctggatttgtacctacttatgaagacaaagatggagattggatgttggtcggtgatgttccatgggacatgttctcttcatcttgtcaaaaactcagaatcatgaaaggatccgaagctcctactgccttatga

SEQ ID NO: 486 - protein, 168 aa, Arabidopsis thaliana
MEVTNGLNLKDTELRLGLPGAQEEQQLELSCVRSNNKRKNNDSTEESAPPPAKTQIVGWPPVRSNRKNNNNKNVSYVKVSMDGAPYLRKIDLKMYKNYPELLKALENMFKFTVGEYSEREGYKGSGFVPTYEDKDGDWMLVGDVPWDMFSSSCQKLRIMKGSEAPTAL

SEQ ID NO: 487 - DNA, 741 bp, Arabidopsis thaliana
atggaaggcggttccgctagtggatcggcttcggctttgtcaaacgatgaaaatctcgtcgtttcttgtgaggattcttcttctcctatagggaatgagcttgagcttggtcttacgttgagccttggtcgcaaagggtatcgagattgtagggtttacgctgatgattcttcttcttcttcatcatcttcttctctgagcagagctagcgtaattgctgggatcaagaggacagctgattccatggctgcaactagtgggcaagttgtgggatggccaccaataaggacttacagaatgaacagtatggttaaccaagctaaggcttcagccactgaagatccgaacttggagataagtcaagccgtaaacaagaatagaagtgattcaacaaagatgagaaattccatgtttgttaaggtgactatggatggcattcctattggaaggaaaatcgatctgaatgctcataaatgctatgaatcattgtcaaacactctagaggaaatgtttctgaaacctaaattaggttcacgcacactagaaaccgatggtcacatggaaacaccggtcaagatactaccagatgggtcttccggattagtactaacgtatgaagacaaggaaggagattggatgcttgttggcgatgttccgtgggggatgtttattggttcagtgagaaggctccggataatgaaaacatcggaggctactggtaaagctcagatgatattatga

SEQ ID NO: 488 - protein, 246 aa, Arabidopsis thaliana
MEGGSASGSASALSNDENLVVSCEDSSSPIGNELELGLTLSLGRKGYRDCRVYADDSSSSSSSSSLSRASVIAGIKRTADSMAATSGQVVGWPPIRTYRMNSMVNQAKASATEDPNLEISQAVNKNRSDSTKMRNSMFVKVTMDGIPIGRKIDLNAHKCYESLSNTLEEMFLKPKLGSRTLETDGHMETPVKILPDGSSGLVLTYEDKEGDWMLVGDVPWGMFIGSVRRLRIMKTSEATGKAQMIL

SEQ ID NO: 489 - DNA, 918 bp, Arabidopsis thaliana
atgtctgtatctgtagcagcagagcatgattacataggtttgtcagagtttccaaccatggaagcaacaacaatgtctgacaaaaccaaaaccagagacaataacaacggtctcaatttcaaggctaccgagttaagactcggtttacccggttctgagtcgccggagcgagtcgactcaagattcttggctctcaacaagagtagctgtcccgtgtcaggtgccaaaagggtgttctccgacgctattaacgactctaacaaatgggtcttctctcctggatccactactgctactggtgatgtcggctcgggttctggtccccgtacctccgtcgttaaagatggaaagtcgacaactttcactaaaccggctgttccggttaaggagaagaagagctctgctacagctccagcttcaaaagcacaagtggtgggatggccaccaataagatcattcaggaagaactcaatggcttcttctcaatctcagaaacctggtaataactcagagactgaagaagcagaagctaagtctggaccagaacaaccttgcttgtatgtcaaagtgagtatggaaggtgctccttacttgaggaaaatcgatctcaagacttacaaaagctaccttgagctctcttctgctcttgagaagatgttcagttgcttcaccattggtcagtttggttctcatggagggtgtggcagagatgggttaaacgagagtcgcttgactgatctcttgcgtggttctgagtatgttgtaacctatgaagataaagacagtgactggatgctggtcggagatgtcccttgggaaatgtttatatgctcctgcaagaagctgagaatcatgaagagctctgaggctatcggcttagctccaagggtgatggagaagtgcagaagcaggaactag

SEQ ID NO: 490 - protein, 305 aa, Arabidopsis thaliana
MSVSVAAEHDYIGLSEFPTMEATTMSDKTKTRDNNNGLNFKATELRLGLPGSESPERVDSRFLALNKSSCPVSGAKRVFSDAINDSNKWVFSPGSTTATGDVGSGSGPRTSVVKDGKSTTFTKPAVPVKEKKSSATAPASKAQVVGWPPIRSFRKNSMASSQSQKPGNNSETEEAEAKSGPEQPCLYVKVSMEGAPYLRKIDLKTYKSYLELSSALEKMFSCFTIGQFGSHGGCGRDGLNESRLTDLLRGSEYVVTYEDKDSDWMLVGDVPWEMFICSCKKLRIMKSSEAIGLAPRVMEKCRSRN

SEQ ID NO: 491 - DNA, 756 bp, Arabidopsis thaliana
atggagttggatcttggtctatctctttcacctcataaatcttccaagttagggtttaactttgacctcaacaagcattgtgcgatcgagggtgctgcgtcttgtttgggtaccgaaaaactgcgttttgaggcgacgtttgggttagggaatgtggaggaaaattgttatatgccaaaacagcgtttgtttgccttgaatggccagcccaacgaggaagacgaagatcctctggaatccgagtcttcaatagtttacgatgatgaggaggaaaatagcgaagttgttggatggccaccagtaaaaacatgtatgataaagtatggtagttatcatcatcgtcatattcgtaatcaccatcattgcccgtatcatcatcgtggtaggaggatcacggcgatgaacaacaacatatctaatccaacaacggctactgtgggatcatcatcttcttcgtcaatatcatcaagatcatcaatgtatgttaaggttaagatggatggtgtggcaatagcaagaaaagtggatatcaagctttttaactcttacgagtccctcactaactccttgatcactatgtttaccgaatatgaagattgcgacagagaagatacaaattatacattcaccttccaagggaaagagggtgactggctacttcgaggggatgttacatggaagatctttgcggaatctgttcatcggatatcaataattagagatcgaccgtgtgcatatacaagatgtttgttttaa

SEQ ID NO: 492 - protein, 251 aa, Arabidopsis thaliana
MELDLGLSLSPHKSSKLGFNFDLNKHCAIEGAASCLGTEKLRFEATFGLGNVEENCYMPKQRLFALNGQPNEEDEDPLESESSIVYDDEEENSEVVGWPPVKTCMIKYGSYHHRHIRNHHHCPYHHRGRRITAMNNNISNPTTATVGSSSSSSISSRSSMYVKVKMDGVAIARKVDIKLFNSYESLTNSLITMFTEYEDCDREDTNYTFTFQGKEGDWLLRGDVTWKIFAESVHRISIIRDRPCAYTRCLF

SEQ ID NO: 493 - DNA, 561 bp, Arabidopsis thaliana
atggaaaaagttgatgtttatgatgagcttgttaacctaaaggcaacagagctgagattgggattaccagggacagaagaaactgtttcttgtggaaaaagcaacaaaagagttttacctgaagctactgagaaagagattgaatccactggaaaaactgaaaccgcttctcctccaaaggctcagattgttggatggccaccagttagatcttacagaaagaacaatgttcagacaaagaagagtgaatctgaaggtcaaggaaactatgtgaaagtaagtatggatggtgctccatatctaaggaagatagatctaacgatgtataaacaatatccagagttgatgaaatcacttgaaaacatgtttaaattctctgtgggagaatattttgagagagaaggatataaaggctcagactttgtacctacttatgaagacaaagatggtgattggatgcttgttggtgatgttccttgggagatgtttgtttcgtcttgtaagaggctaaggatcatgaaaggatctgaagttaaaggtttaggttgtggtggtctttaa

SEQ ID NO: 494 - protein, 186 aa, Arabidopsis thaliana
MEKVDVYDELVNLKATELRLGLPGTEETVSCGKSNKRVLPEATEKEIESTGKTETASPPKAQIVGWPPVRSYRKNNVQTKKSESEGQGNYVKVSMDGAPYLRKIDLTMYKQYPELMKSLENMFKFSVGEYFEREGYKGSDFVPTYEDKDGDWMLVGDVPWEMFVSSCKRLRIMKGSEVKGLGCGGL

SEQ ID NO: 495 - DNA, 516 bp, Arabidopsis thaliana
atgaatagtttcgagccacaaagccaagactctttgcaaagaaggtttcatcaagacaacagcaccacacaacaacctcgtgacaccacgacacctttcatacccaaaccggcttccaaaaaccataataatagcaactccagctctggagcggccgggagatcattccaaggctttgggcttaacgtagaggacgatcttgtttcatcggtggttcctccggttacggttgtgctagagggacgttctatatgtcaacgcataagcctagacaagcatgggagttatcagagcttggcttcggctctaaggcaaatgtttgtcgatggagctgattcaacggacgatcttgatctgtcaaacgccattcctggccatcttattgcttatgaagacatggagaacgatctccttcttgccggagatcttacttggaaggactttgttcgtgtagcgaagagaattcgaatcttgccggtcaagggaaacacaagacaagttaaaagaaacgagtga

SEQ ID NO: 496 - protein, 171 aa, Arabidopsis thaliana
MNSFEPQSQDSLQRRFHQDNSTTQQPRDTTTPFIPKPASKNHNNSNSSSGAAGRSFQGFGLNVEDDLVSSVVPPVTVVLEGRSICQRISLDKHGSYQSLASALRQMFVDGADSTDDLDLSNAIPGHLIAYEDMENDLLLAGDLTWKDFVRVAKRIRILPVKGNTRQVKRNE

SEQ ID NO: 497 - DNA, 1017 bp, Arabidopsis thaliana
atgtccccggaagaggagctacagagcaatgtatcggtggctagttcttcacctactagcaattgcatctccaggaacactctaggaggacttaaagagcataactacttgggtctctctgattgttcttctgttggaagctctactctctctccccttgctgaagatgacaaagctactatcagcctcaaggctacggagctgacacttggtcttcctggatcacaatctcctgcgagagacacagagcttaaccttttgagcccagcaaagctagatgagaagccattctttcctttgcttccttctaaagatgagatatgctcctcctcgcaaaagaacaatgcatcgggaaacaaaagaggcttttctgacacaatggatcagtttgctgaagctaaaagttcagtgtatactgagaaaaactggatgttccctgaagcagcagccacccagtctgtaacaaagaaagatgtgccacaaaacatacccaaaggacagtctagcactacaaacaatagctctagtccacctgcagccaaggcacaaattgtcggttggcctccagtgagatcctacaggaagaacacattggccactacttgtaagaacagtgacgaagttgatgggaggccaggttctggggctctcttcgtgaaggtcagtatggatggtgctccttatctgaggaaagttgacctgaggagctacactaactacggggagctttcttcagccttggagaaaatgttcaccactttcactcttggtcaatgtggatctaatggagctgctgggaaggatatgcttagtgagaccaagctcaaggatcttttgaatggaaaagactatgtgctcacttatgaggataaggatggtgactggatgcttgttggagatgttccgtgggagatgtttattgatgtctgcaagaagctgaagataatgaaagggtgtgatgctattgggttagctgcagctccgagagcaatggagaaatcgaagatgagagcttaa

SEQ ID NO: 498 - protein, 338 aa, Arabidopsis thaliana
MSPEEELQSNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLAAAPRAMEKSKMRA

SEQ ID NO: 499 - DNA, 1011 bp, Arabidopsis thaliana
atgtccccggaagaggagctacagagcaatgtatcggtggctagttcttcacctactagcaattgcatctccaggaacactctaggaggacttaaagagcataactacttgggtctctctgattgttcttctgttggaagctctactctctctccccttgctgaagatgacaaagctactatcagcctcaaggctacggagctgacacttggtcttcctggatcacaatctcctgcgagagacacagagcttaaccttttgagcccagcaaagctagatgagaagccattctttcctttgcttccttctaaagatgagatatgctcctcctcgcaaaagaacaatgcatcgggaaacaaaagaggcttttctgacacaatggatcagtttgctgaagctaaaagttcagtgtatactgagaaaaactggatgttccctgaagcagcagccacccagtctgtaacaaagaaagatgtgccacaaaacatacccaaaggacagtctagcactacaaacaatagctctagtccacctgcagccaaggcacaaattgtcggttggcctccagtgagatcctacaggaagaacacattggccactacttgtaagaacagtgacgaagttgatgggaggccaggttctggggctctcttcgtgaaggtcagtatggatggtgctccttatctgaggaaagttgacctgaggagctacactaactacggggagctttcttcagccttggagaaaatgttcaccactttcactcttggtcaatgtggatctaatggagctgctgggaaggatatgcttagtgagaccaagctcaaggatcttttgaatggaaaagactatgtgctcacttatgaggataaggatggtgactggatgcttgttggagatgttccgtgggagatgtttattgatgtctgcaagaagctgaagataatgaaagggtgtgatgctattgggttagctccgagagcaatggagaaatcgaagatgagagcttaa

SEQ ID NO: 500 - protein, 336 aa, Arabidopsis thaliana
MSPEEELQSNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLAPRAMEKSKMRA

SEQ ID NO: 501 - DNA, 600 bp, Oryza sativa
atgtcggtggagacggagcggagctccacggagtcgtccgccgcgtcggggctcgacttcgaggacaccgccctcaccctccgcctcccgggctccctcgccgccgccgccgcacctgaccccgaccgcaagcgctcctccccctcctcctccgacgccgccgacgccgcagacaactcctcccccctcgccgccgccgccgatgctccccctgctcccaaggcgagggtggtggggtggccgccggtgaggtcgttcaggaagaacgcgctggcggccaagttcgtgaaggtggccgtggacggcgcgccgtacctgcgcaaggtggacctcgaggcctactccggctacgaccagctcctccgcgcgctccaggacaagttcttctcccacttcaccatccggaagttcgccgacgacgagaggaagctggtggacgcggtgaacgggacggagtacgtgccgacgtacgaggacaaggacggcgactggatgctcgtcggcgacgtcccctggaagatgtttgtggaaacttgccagcgccttcgtctcatgaaaagctcagaggctgtcaacttagcaccaagagccgctcaatga

SEQ ID NO: 502 - protein, 199 aa, Oryza sativa
MSVETERSSTESSAASGLDFEDTALTLRLPGSLAAAAAPDPDRKRSSPSSSDAADAADNSSPLAAAADAPPAPKARVVGWPPVRSFRKNALAAKFVKVAVDGAPYLRKVDLEAYSGYDQLLRALQDKFFSHFTIRKFADDERKLVDAVNGTEYVPTYEDKDGDWMLVGDVPWKMFVETCQRLRLMKSSEAVNLAPRAAQ

SEQ ID NO: 503 - DNA, 792 bp, Oryza sativa
atgtcgccgcccctcgagctcgactacataggcctctcgcctccgccgccgccgccctcctcctcctccgccgccgccgcccgcgcggacgacgtcgacctgaagggcaccgagctccgcctcggcctccctggctccgagtcgccggaccgccgccctgcggctattgccgctgccgctgccactgccaccacccttgagctgctgcccgccaagggtgccaagcgcgtgttccccgacgaggccgcgctgacgccgcccactgccgccgccgggaagggcaaggcggcgagggagggggaggaggtgggggctgaggaggaggacaagaaggtcgccgcgccgccgcagccggctgcgaaggctcaggtggtgggatggccaccaatccgcagctaccgcaagaacacgatggcaaccaaccagataaagagcaacaaggaggatgttgatgctaagcagggtcagggtttcctgtacgtcaaggttagcatggatggtgcaccatatctgaggaaggtggacctcaaaacttacaagaactacaaggacatgtctttgggtctcgagaaaatgttcattggcttcagcaccggtaaggaaggtgctgagaaccagaaagatggtgaatatgtgttaacctacgaagacaaggatggtgactggatgctggttggtgatgttccatgggagatgttcaccgactcttgccggaggctcagaatcatgaaaggctcagatgcaattggacttgccccaagagcaggggaaaagtccaagaacaggaactag

SEQ ID NO: 504 - protein, 263 aa, Oryza sativa
MSPPLELDYIGLSPPPPPPSSSSAAAARADDVDLKGTELRLGLPGSESPDRRPAAIAAAAATATTLELLPAKGAKRVFPDEAALTPPTAAAGKGKAAREGEEVGAEEEDKKVAAPPQPAAKAQVVGWPPIRSYRKNTMATNQIKSNKEDVDAKQGQGFLYVKVSMDGAPYLRKVDLKTYKNYKDMSLGLEKMFIGFSTGKEGAENQKDGEYVLTYEDKDGDWMLVGDVPWEMFTDSCRRLRIMKGSDAIGLAPRAGEKSKNRN

SEQ ID NO: 505 - DNA, 792 bp, Oryza sativa; identical to SEQ ID NO: 503

SEQ ID NO: 506 - protein, 263 aa, Oryza sativa; identical to SEQ ID NO: 504

SEQ ID NO: 507 - DNA, 612 bp, Oryza sativa
atggaggagtgcaagggcggtggcatgtcgccgtcctcctccatggatagcagcacccacccggcgctgtccacgacgtcgtcggcggcgacggcgaggcgggacctcagcaccgatctccggctagggcttagcctctcgacgtcgtcgtcgtcctccctcctgcaggccgccgccgccgccgccgctgctgatgatagcatcccttctactccaaggaacagccaagtgcacgccgattggccgccgatcaagccgttcctcaggagcgccttgcagaaggcgtcggccgctggcggcggcggcgctcgccgacggcgaacgctgttcgtgaaggtgtacatggagggcgtcccgatcggccggaagctcgacctgctcttgctggatgggtatgacagcctcctcatcaagctctgccacatgttcaagacgcccatcacctatgctgatgttatggagtgccatcaacaagttcctggccagaaggctgcccatgtcctcacctatgaagaccaggacggggactggatgatggttggggacgtcccatgggaactcttcctgagcagcgtaaagaagctcaggattgcaaggatggataaatgctaa

SEQ ID NO: 508 - protein, 203 aa, Oryza sativa
MEECKGGGMSPSSSMDSSTHPALSTTSSAATARRDLSTDLRLGLSLSTSSSSSLLQAAAAAAAADDSIPSTPRNSQVHADWPPIKPFLRSALQKASAAGGGGARRRRTLFVKVYMEGVPIGRKLDLLLLDGYDSLLIKLCHMFKTPITYADVMECHQQVPGQKAAHVLTYEDQDGDWMMVGDVPWELFLSSVKKLRIARMDKC

SEQ ID NO: 509 - DNA, 816 bp, Oryza sativa
atgtcgcctcccctcgagccgcacgactacatcggcctctccgctgcggcggcgtccccgacgccgagctcgtcgtcctgctcgtcctcgccgaacccaggcggcgaggcccgcggcccacgcctcacgctccgcctcggcctcccggggtcggagtcccccgagcgggaggtcgtcgccgcggggctcaccctcgggcctctgcccccgaccaccaccaaggcggcctccaagcgcgccttccccgactcctccccgcggcacggcgccagctccggctccgtcgccgccgccgcagcttgccaggacaaggcggcccccgccgccgctccgccggctgcaaaggcgcaggtggtgggatggccgcccgtgcggaactaccgaaagaacacgctggcggcgagcgcctccaagggcaaaggggaggacaagggcacggctgaagggggccctctctatgtcaaggtgagcatggatggagccccctacctcaggaaggtcgacctcaagatgtattctagctatgaggacctctccatggctctcgagaagatgttcagctgcttcatcactggtcaaagcggtttgcgtaaatcatcaaacagagataggcttactaatggttcaaaggctgatgccctccaagaccaagagtatgtccttacatatgaagataaggatgctgactggatgcttgttggtgatcttccttgggatttgtttaccactatctgccggaaattgaaaatcatgagaggatctgatgctgctggaatagctccaagatcaatagagcagtcagggcagagcagataa

SEQ ID NO: 510 - protein, 271 aa, Oryza sativa
MSPPLEPHDYIGLSAAAASPTPSSSSCSSSPNPGGEARGPRLTLRLGLPGSESPEREVVAAGLTLGPLPPTTTKAASKRAFPDSSPRHGASSGSVAAAAACQDKAAPAAAPPAAKAQVVGWPPVRNYRKNTLAASASKGKGEDKGTAEGGPLYVKVSMDGAPYLRKVDLKMYSSYEDLSMALEKMFSCFITGQSGLRKSSNRDRLTNGSKADALQDQEYVLTYEDKDADWMLVGDLPWDLFTTICRKLKIMRGSDAAGIAPRSIEQSGQSR

SEQ ID NO: 511 - DNA, 786 bp, Oryza sativa
atggaagaagggtccaacaaaagagaaggacttcctcctcaactcctagatctcatcccagatgagaaggaatggaagctgagagaagcattaggtctagggagatcaagaaacgcaggcttcgacggtgaagaagacaagaagctagacctaaagcttggtcttcctggttttatagaagatgatgaggcagaaaccttaagagattacaggctacagcaagagagcccatctctctcccttagtttctttccaaagcactccaagaccaccagcagcactactacgacaactggagcaaagaggggattcatagacacagttgaggacaaaacagaaggttataacgaccagaagcagcaggcaagggcaggatgtgggaaggaacttgcagtggaggaaatgatagcagccgtgagtgagaggaagaaaggatgctgccccccaccaccaccaccacatggtgctcctgctacacctgcgcgcaacagaccacagacccagggaagaggagctgcagcaccagtggttggttggcctccaattcgatccttcaggagaaaccttgctagtagtagttcatccaaacattcccctgaaccacaaaatgataatgccaatgcaaaggtgacgctcacctgcaagaaaaaccctcttgtaaaaatcaacatggatgggatccctattggaaggaaaatagaccttgcagcctataacagctatgatgggctatcgtcagctgtcaaacaactcttccatgggtttcttcaagcaaggtgcagatga

SEQ ID NO: 512 - protein, 261 aa, Oryza sativa
MEEGSNKREGLPPQLLDLIPDEKEWKLREALGLGRSRNAGFDGEEDKKLDLKLGLPGFIEDDEAETLRDYRLQQESPSLSLSFFPKHSKTTSSTTTTTGAKRGFIDTVEDKTEGYNDQKQQARAGCGKELAVEEMIAAVSERKKGCCPPPPPPHGAPATPARNRPQTQGRGAAAPVVGWPPIRSFRRNLASSSSSKHSPEPQNDNANAKVTLTCKKNPLVKINMDGIPIGRKIDLAAYNSYDGLSSAVKQLFHGFLQARCR

SEQ ID NO: 513 - DNA, 618 bp, Oryza sativa
atggagtgcatggcgagtactgaagagtctctcccagcttcttcctccatggatagttgcagcggcgaactgccgacgacgacgacgacggcgccggcgcaatccacggcgtcttccggctgccgaccgccggcgacggcggcgaagcggcggagtctgatcagcacagatcttcgcctcgggctcaccctctcctccgtcgtccacatcgacggcaacaacccttctaccccaaggagttccctcacgacggcgacagtgacagctgatcgaggcggcggcggcggcggccatggacggcgacggtcactgttcgtgaaggtgtacatggagggcgtccccatcggcaggaagctggacctgctgccgctggacggctacaaaggtctcgtcgcacggctcgcctccatgttcagagcatccatcacctatcatcattgccatcgacagttcgccgtcgtcgggatgaagacgaacaaggttcatcatgttctgacatacgaagaccaggagggagactggatgatggctggagacgtgccatgggagctgttcctgacaagcgtgaagagattgaggattgcaagagcggatgacaagtactgctatagctgttga

SEQ ID NO: 514 - protein, 205 aa, Oryza sativa
MECMASTEESLPASSSMDSCSGELPTTTTTAPAQSTASSGCRPPATAAKRRSLISTDLRLGLTLSSVVHIDGNNPSTPRSSLTTATVTADRGGGGGGHGRRRSLFVKVYMEGVPIGRKLDLLPLDGYKGLVARLASMFRASITYHHCHRQFAVVGMKTNKVHHVLTYEDQEGDWMMAGDVPWELFLTSVKRLRIARADDKYCYSC

SEQ ID NO: 515 - DNA, 549 bp, Oryza sativa
atggagctggagcttgggctggcgccaccgaattccggtcatctcgtcgtcgacgagctcagcagcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctggttggggacgtgccatgggatgattttgcacgatctgtgaaacgcctgaagatactgggttaa

SEQ ID NO: 516 - protein, 182 aa, Oryza sativa
MELELGLAPPNSGHLVVDELSSSSSSGGGSGSAPVSASSAGKRGFREAFQETLLLFDDGSCCNTSDDDCRRRKKTVVGWPPVSSARRACGGANYVKVKKEGDAIGRKVDLALHSSYDELAATLARMFPTNDHQGEKKMANDDHGDAAGPVVTYEDGDGDWMLVGDVPWDDFARSVKRLKILG

SEQ ID NO: 517 - DNA, 846 bp, Oryza sativa
atgagaggaggagtagctgggcccaccgccggcgagccgccggggacggaggcggaggcggaggaggtggaggagagctcagctggggacgacgaggagctggagctcgggctcagccttggctccaagaaacagcagcagcagcagcatgcgccgtgccgaatcctgacggccagggacctgcagccggcggcggcgctgtcaccggactcctccgtgtcgtcgtcatcccccgcggcggcggcggcggcgggggggaagagggctgagggccccaccgccaccacctcgcctgggacggttgcttccggccatccacacagcagctttggagtggtgggatggccaccgatccgacagttcaggatgaacagcctgttcaatcaggctaaagaaaacacatctgaaaccgacaccaagaagaccgccaccaatgaatctgatgtgcagaaggacaaggaggagggcgaaaagaaaggacgggttgctggatgggtgaaggtgaacatggatggagaggtcattggaaggaaggtggatctcaatgcgcaccgctcatacaagacccttgcattagcccttgaactcatgttcacgaagccgtccattggcctttgcgcttctcataatacaaactcgctgaaactactagacaactctgccgaataccagctcacctacgaggacagggatggtgactggatgctcgttggagatgttccttgggaaatgtttgtcagctctgtgaagaggttgaggatcatgaggacatcagatgcgaatggtcttggtcagcgataccagggaattcacagaaccattgcttcaacaagaggcagatcctga

SEQ ID NO: 518 - protein, 281 aa, Oryza sativa
MRGGVAGPTAGEPPGTEAEAEEVEESSAGDDEELELGLSLGSKKQQQQQHAPCRILTARDLQPAAALSPDSSVSSSSPAAAAAAGGKRAEGPTATTSPGTVASGHPHSSFGVVGWPPIRQFRMNSLFNQAKENTSETDTKKTATNESDVQKDKEEGEKKGRVAGWVKVNMDGEVIGRKVDLNAHRSYKTLALALELMFTKPSIGLCASHNTNSLKLLDNSAEYQLTYEDRDGDWMLVGDVPWEMFVSSVKRLRIMRTSDANGLGQRYQGIHRTIASTRGRS

SEQ ID NO: 519 - DNA, 843 bp, Oryza sativa
atgagaggaggagtagctgggcccaccgccggcgagccgccggggacggaggcggaggcggaggaggtggaggagagctcagctggggacgacgaggagctggagctcgggctcagccttggctccaagaaacagcagcagcagcagcatgcgccgtgccgaatcctgacggccagggacctgcagccggcggcggcgctgtcaccggactcctccgtgtcgtcgtcatcccccgcggcggcggcggcggcgggggggaagagggctgagggccccaccgccaccacctcgcctgggacggttgcttccggccatccacacagctttggagtggtgggatggccaccgatccgacagttcaggatgaacagcctgttcaatcaggctaaagaaaacacatctgaaaccgacaccaagaagaccgccaccaatgaatctgatgtgcagaaggacaaggaggagggcgaaaagaaaggacgggttgctggatgggtgaaggtgaacatggatggagaggtcattggaaggaaggtggatctcaatgcgcaccgctcatacaagacccttgcattagcccttgaactcatgttcacgaagccgtccattggcctttgcgcttctcataatacaaactcgctgaaactactagacaactctgccgaataccagctcacctacgaggacagggatggtgactggatgctcgttggagatgttccttgggaaatgtttgtcagctctgtgaagaggttgaggatcatgaggacatcagatgcgaatggtcttggtcagcgataccagggaattcacagaaccattgcttcaacaagaggcagatcctga

SEQ ID NO: 520 - protein, 280 aa, Oryza sativa
MRGGVAGPTAGEPPGTEAEAEEVEESSAGDDEELELGLSLGSKKQQQQQHAPCRILTARDLQPAAALSPDSSVSSSSPAAAAAAGGKRAEGPTATTSPGTVASGHPHSFGVVGWPPIRQFRMNSLFNQAKENTSETDTKKTATNESDVQKDKEEGEKKGRVAGWVKVNMDGEVIGRKVDLNAHRSYKTLALALELMFTKPSIGLCASHNTNSLKLLDNSAEYQLTYEDRDGDWMLVGDVPWEMFVSSVKRLRIMRTSDANGLGQRYQGIHRTIASTRGRS

SEQ ID NO: 521 - DNA, 702 bp, Oryza sativa
atggctggcctcgggttcgacgagaccgagctccggctcggccttcccggcgccggcgagctggcagcgaggagctccggcaagaggggcttcgccgagaccatcgacctcaagctcaagctgcagccggcggcgcctgctgccgtctctggggaagagggtgctcaggaggacaaggaagatgccgacgcggcggcggcggccgccgacgagaagatgtcgatgaagaggtcggcgagccagagcagcgtggtcaccgcggagcccgatcccgacaagccgcgcgcgcccaaggcgcaggtggtggggtggccgccggtccggtcgttcaggaagaacgtgctcgccgagaaatgcaaggcggcggcgctggtgaaggtgagcatggacggcgcgccgtacctgaggaagatcgacgtcgccatgtacaagagctacccggagttgtccatggcgttccagaacatgttcacctccttcaccatcggcaagtgtgggtcccatcagcagctgaaggagagcaataagctgagagatgacctggagtacgtgccgacgtacgaggacaaggacggcgactggatgctcgtcggcgacgtcccgtgggagatgttcgtcgagtcgtgcaaacgcctccgaatcatgaaagggtctgaagccattggccttgcaccaagggcagtggagaaatgcaagagctga

SEQ ID NO: 522 - protein, 233 aa, Oryza sativa
MAGLGFDETELRLGLPGAGELAARSSGKRGFAETIDLKLKLQPAAPAAVSGEEGAQEDKEDADAAAAAADEKMSMKRSASQSSVVTAEPDPDKPRAPKAQVVGWPPVRSFRKNVLAEKCKAAALVKVSMDGAPYLRKIDVAMYKSYPELSMAFQNMFTSFTIGKCGSHQQLKESNKLRDDLEYVPTYEDKDGDWMLVGDVPWEMFVESCKRLRIMKGSEAIGLAPRAVEKCKS

SEQ ID NO: 523 - DNA, 681 bp, Oryza sativa
atggaagccgccgtggggtacgccgccgacagcctcatcaaggccaccgagctcaggctgggcctgcctgggacagccgacgacctgccctccacgcccaggggcaagaagcgcgccgccgcggcggaggacaacaacgccaacgccgccgccgccgacgacgacgagcacgacgccgtcgaggccgcgccgccggtagccaaggctcaagtggtcgggtggccgccggtgaggtcgtacaggaagagctgcttccagcaacagtcagcggcggcgagcaagagcaaggccgccgtgagcagctgcaacaacaaagacgagcccatcaccaagaacgcggcgccggcgccggcagcctcctcggcggcggcggccaacggcgggtcgctggtgaaggtgagcatggacggggcgccgtacctgaggaagatcgacctgaggatgtacaagggctacagggagctccgcgaggccctggaggccatgttcgtctgcttctccggcgccgccgacggtgccaacccgtcggagttcgccatcacctaccaggacaaggacggcgacctcatgctcgtcggcgacgtccctttcgacatgttcaccagcacatgcaagaagttgaggatcatgaagagatctgaagccacagggctaggatcaccaaggcaaatgaagatctaa

SEQ ID NO: 524 - protein, 226 aa, Oryza sativa
MEAAVGYAADSLIKATELRLGLPGTADDLPSTPRGKKRAAAAEDNNANAAAADDDEHDAVEAAPPVAKAQVVGWPPVRSYRKSCFQQQSAAASKSKAAVSSCNNKDEPITKNAAPAPAASSAAAANGGSLVKVSMDGAPYLRKIDLRMYKGYRELREALEAMFVCFSGAADGANPSEFAITYQDKDGDLMLVGDVPFDMFTSTCKKLRIMKRSEATGLGSPRQMKI

SEQ ID NO: 525 - DNA, 711 bp, Oryza sativa
atggccggcgccgacgtggacgtcgggacggagctccggctggggctgcccggaggtggcggcggcgccgccgaggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactgggaacaatatgaatgaggtgaatggctctgatgctgttacaacttatgaagacaaggatggtgactggatgcttgttggagatgtcccgtggcagatgtttgtcgagtcatgcaaacgcttgaggatcatgaagggttccgaagccattggtcttgcaccaagagcaaaggacaagtacaagaacaagagctga

SEQ ID NO: 526 - protein, 236 aa, Oryza sativa
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAVTTYEDKDGDWMLVGDVPWQMFVESCKRLRIMKGSEAIGLAPRAKDKYKNKS

SEQ ID NO: 527 - DNA, 594 bp, Oryza sativa
atggccatggcggcggagagcatcgacgcggagctgcgcctcgggctgcccggcagcggcggcggtgacggcgtggcggcgaagaagcggcggtcggcgtcgtcgacggtgaagagcgaggcctccggcacggcctgctgcggcggcgccggcgcccgggacgtcgaagacggcgcctcgccggcgtccaaagtgcaggtggtggggtggccgccggtggggtcgtacaggaggagcacgttccagtcttcgtcgtcgtcgacggcggcggcggcgaaggggaagggcggcggcgagacggatcaagggaggaagaataagggaggagggctgtacgtgaaggtgagcatggacggggcgccatacctccgcaaggtcgacctccggatgtacggcggctacagggagctcagggacgctctcgacgcgctcttcggctgcttctccgccgacgcctccgcctccgccgcccacttcgccgtcgcctatgaggacaaggacggcgacctcatgctcgccggcgacgtgccctgggacatgttcatctcttcttgcaagaagctgcggataatgcgaggatctgaggcgagatga

SEQ ID NO: 528 - protein, 197 aa, Oryza sativa
MAMAAESIDAELRLGLPGSGGGDGVAAKKRRSASSTVKSEASGTACCGGAGARDVEDGASPASKVQVVGWPPVGSYRRSTFQSSSSSTAAAAKGKGGGETDQGRKNKGGGLYVKVSMDGAPYLRKVDLRMYGGYRELRDALDALFGCFSADASASAAHFAVAYEDKDGDLMLAGDVPWDMFISSCKKLRIMRGSEAR

SEQ ID NO: 529 - DNA, 756 bp, Oryza sativa
atgtcggtggagacggagcggagctcgacggagtcatcggcggcgtccgggctcgacttcgaggacaccgccctcaccctccgcctcccgggctcctcctcctcctcctcctcctcctcgtcatcctcctcctcctcgtcgccgtcggagcccgaccgcaagcgcgcctccgccaccgacgacgaccccgacaaccgcctcggctccaccgccaccgagtcccccccttcccccaaggcgcgggtggtcgggtggccgccggtgcgcgcgttccggaagaacgcgctcgcggcgttggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccgcaagctcgggaacgaggagatgaagctcgtcgacgcggtgagcggcaacgagtacgtgccgacgtacgaggacaaggacggcgactggatgctcgtcggagacgtcccctggaaaatgtttgtggagacctgccaacgtcttcgtctcatgaaaagctctgaagcagtcaatttaggtacagtgtcctcttggtcttgtatgttgtttttcatagttgccaccgtgactttctgtatggttcaacaacgtattttcgggcaaaatcctaaattttcccccttctcacatgcagcaccaagatctgcttga

SEQ ID NO: 530 - protein, 251 aa, Oryza sativa
MSVETERSSTESSAASGLDFEDTALTLRLPGSSSSSSSSSSSSSSSSPSEPDRKRASATDDDPDNRLGSTATESPPSPKARVVGWPPVRAFRKNALAALAAASSSKAKFVKVAVDGAPYLRKVDLEAYRGYDQLLAALQDKFFSHFTIRKLGNEEMKLVDAVSGNEYVPTYEDKDGDWMLVGDVPWKMFVETCQRLRLMKSSEAVNLGTVSSWSCMLFFIVATVTFCMVQQRIFGQNPKFSPFSHAAPRSA

SEQ ID NO: 531 - DNA, 639 bp, Oryza sativa
atgtcggtggagacggagcggagctcgacggagtcatcggcggcgtccgggctcgacttcgaggacaccgccctcaccctccgcctcccgggctcctcctcctcctcctcctcctcctcgtcatcctcctcctcctcgtcgccgtcggagcccgaccgcaagcgcgcctccgccaccgacgacgaccccgacaaccgcctcggctccaccgccaccgagtcccccccttcccccaaggcgcgggtggtcgggtggccgccggtgcgcgcgttccggaagaacgcgctcgcggcgttggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccgcaagctcgggaacgaggagatgaagctcgtcgacgcggtgagcggcaacgagtacgtgccgacgtacgaggacaaggacggcgactggatgctcgtcggagacgtcccctggaaaatgtttgtggagacctgccaacgtcttcgtctcatgaaaagctctgaagcagtcaatttagcaccaagatctgcttga

SEQ ID NO: 532 - protein, 212 aa, Oryza sativa
MSVETERSSTESSAASGLDFEDTALTLRLPGSSSSSSSSSSSSSSSSPSEPDRKRASATDDDPDNRLGSTATESPPSPKARVVGWPPVRAFRKNALAALAAASSSKAKFVKVAVDGAPYLRKVDLEAYRGYDQLLAALQDKFFSHFTIRKLGNEEMKLVDAVSGNEYVPTYEDKDGDWMLVGDVPWKMFVETCQRLRLMKSSEAVNLAPRSA

SEQ ID NO: 533 - DNA, 603 bp, Oryza sativa
atgtcggtggagacggagcggagctcgacggagtcatcggcggcgtccgggctcgacttcgaggacaccgccctcaccctccgcctcccgggctcctcctcctcctcctcctcctcctcgtcatcctcctcctcctcgtcgccgtcggagcccgaccgcaagcgcgcctccgccaccgacgacgaccccgacaaccgcctcggctccaccgccaccgagtcccccccttcccccaaggcgcgggtggtcgggtggccgccggtgcgcgcgttccggaagaacgcgctcgcggcgttggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccctcgggaacgaggagatgaagctcgtcgacgcggtgagcggcaacgagtacgtgccgacgtacgaggacaaggacggcgactggatgctcgtcggagacgtcccctggaaaatgtttgtggagacctgccaacgtcttcgtctcatgaaaagctctga

SEQ ID NO: 534 - protein, 200 aa, Oryza sativa
MSVETERSSTESSAASGLDFEDTALTLRLPGSSSSSSSSSSSSSSSSPSEPDRKRASATDDDPDNRLGSTATESPPSPKARVVGWPPVRAFRKNALAALAAASSSKAKFVKVAVDGAPYLRKVDLEAYRGYDQLLAALQDKFFSHFTIPRERGDEARRRGERQRVRADVRGQGRRLDARRRRPLENVCGDLPTSSSHEKL

SEQ ID NO: 535 - DNA, 567 bp, Oryza sativa
atgtcggtggagacggagcggagctcgacggagtcatcggcggcgtccgggctcgacttcgaggacaccgccctcaccctccgcctcccgggctcctcctcctcctcctcctcctcctcgtcatcctcctcctcctcgtcgccgtcggagcccgaccgcaagcgcgcctccgccaccgacgacgaccccgacaaccgcctcggctccaccgccaccgagtcccccccttcccccaaggcgcgggtggtcgggtggccgccggtgcgcgcgttccggaagaacgcgctcgcggcgttggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccgtgagtcgacatgctcgtgcgcctctgtgcctttccgctgttcttgcgcgatgccgtacgttgttgagagctctggatgcgttcgtccatggccgcaggcaagctcgggaacgaggagatga

SEQ ID NO: 536 - protein, 188 aa, Oryza sativa
MSVETERSSTESSAASGLDFEDTALTLRLPGSSSSSSSSSSSSSSSSPSEPDRKRASATDDDPDNRLGSTATESPPSPKARVVGWPPVRAFRKNALAALAAASSSKAKFVKVAVDGAPYLRKVDLEAYRGYDQLLAALQDKFFSHFTIRESTCSCASVPFRCSCAMPYVVESSGCVRPWPQASSGTRR

SEQ ID NO: 537 - DNA, 564 bp, Oryza sativa
atgtcggtggagacggagcggagctcgacggagtcatcggcggcgtccgggctcgacttcgaggacaccgccctcaccctccgcctcccgggctcctcctcctcctcctcctcctcctcgtcatcctcctcctcctcgtcgccgtcggagcccgaccgcaagcgcgcctccgccaccgacgacgaccccgacaaccgcctcggctccaccgccaccgagtcccccccttcccccaaggcgcgggtggtcgggtggccgccggtgcgcgcgttccggaagaacgcgctcgcggcgttggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccgcaagctcgggaacgaggagatgaagctcgtcgacgcggtgagcggcaacgagtacgtgccgacgtacgaggacaaggacggcgactggatgctcgtcggagacgtcccctggaagtga

SEQ ID NO: 538 - protein, 187 aa, Oryza sativa
MSVETERSSTESSAASGLDFEDTALTLRLPGSSSSSSSSSSSSSSSSPSEPDRKRASATDDDPDNRLGSTATESPPSPKARVVGWPPVRAFRKNALAALAAASSSKAKFVKVAVDGAPYLRKVDLEAYRGYDQLLAALQDKFFSHFTIRKLGNEEMKLVDAVSGNEYVPTYEDKDGDWMLVGDVPWK

SEQ ID NO: 539 - DNA, 426 bp, Oryza sativa
atggcgcgtcgcggcgggcgcagggcgcgggtggtcgggtggccgccggtgcgcgcgttccggaagaacgcgctcgcggcgttggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccgcaagctcgggaacgaggagatgaagctcgtcgacgcggtgagcggcaacgagtacgtgccgacgtacgaggacaaggacggcgactggatgctcgtcggagacgtcccctggaaaatgtttgtggagacctgccaacgtcttcgtctcatgaaaagctctgaagcagtcaatttagcaccaagatctgcttga

SEQ ID NO: 540 - protein, 141 aa, Oryza sativa
MARRGGRRARVVGWPPVRAFRKNALAALAAASSSKAKFVKVAVDGAPYLRKVDLEAYRGYDQLLAALQDKFFSHFTIRKLGNEEMKLVDAVSGNEYVPTYEDKDGDWMLVGDVPWKMFVETCQRLRLMKSSEAVNLAPRSA

SEQ ID NO: 541 - DNA, 687 bp, Oryza sativa
atggcttggaatggcaggtttggagaggatggagaggaagagaggagccttgagctcagccttgccctccctggatacttctccagctcaggtttgcaggggaacacgagcactgctgctgatggagccaagggaaacgatgggttcaaggcaagcaggccggcggctccggtggtcgggtggccgccggtgcggtcgttccggcggaacctcgcctcgtcgtcgtcgtcgtcgaagccgccgcgtggaggccgagacgccgccgccgccgccacgggaggcaaggtggcccggttcgtcaaggtgaacatggacggcgtcccgatcggccggaaggtcgacctggcggcgcacggcggctacggcgagctctccgccgccgtcgaccgtctcttccgcggcctcctcgccgctcaaagggacccaaccatggccaccgccgccgccgccgccgctgccggcgagagctgcacaggagaggaggaggcgatcgccgggctcctcgacggcggcagcggcgagtacacgctcgtctacgaggacgacgagggcgaccagatgctcgtcggcgacgtgccatggaacatgttcatcgccgcggcgaggaggctgcgcgtgctcaggagctccgacctgaacgcctccacgatacgagcagggagcaggaagagggcagctgccgagtga

SEQ ID NO: 542 - protein, 228 aa, Oryza sativa
MAWNGRFGEDGEEERSLELSLALPGYFSSSGLQGNTSTAADGAKGNDGFKASRPAAPVVGWPPVRSFRRNLASSSSSSKPPRGGRDAAAAATGGKVARFVKVNMDGVPIGRKVDLAAHGGYGELSAAVDRLFRGLLAAQRDPTMATAAAAAAAGESCTGEEEAIAGLLDGGSGEYTLVYEDDEGDQMLVGDVPWNMFIAAARRLRVLRSSDLNASTIRAGSRKRAAAE

SEQ ID NO: 543 - DNA, 774 bp, Oryza sativa
atgtcgcccccactcgagctcgactacataggcctctcgccgccggtgcccgccgccgccgatgccgccgccgacaacgacctgaagggcaccgagctccgcctcggcctgcccggctcccactcgccggaccgctccccgcccgccgccacgctcgaccttctccccgctgccaagggcgccaagcgcgggttctccgacgaggcgcgtccgctgccggcgtccgccgccgccgccgccgccgccgggaagggcaagaaggcggcggccggcgaggaggatgaggatgcggaggaggaggacaagaaggtcgccgccgcgccgcaggcgcctgctgccaaggctcaggtggttggatggccaccaattcgcagctaccgcaagaacacgatggctactaaccagctgaagagcagcaaggaggatgctgaagcgaagcagggccaggggttcctgtacgtcaaggtcagcatggatggtgccccctacctcaggaaggtggacctcaagacctacaagaactacaaggacctgtcaactgcgcttgagaagatgttcattggcttcacaactggcaaggatggcttatctgagagccgcaaggatggtgaatatgtgctgacttatgaagacaaggatggagactggatgcttgttggcgatgttccatgggagatgtttgccaactcttgtcgcagactcaggatcatgaaaggttcagatgcaattggacttgctccaagggcagttgataagtccaaaaaccgcaactag

SEQ ID NO: 544 - protein, 257 aa, Oryza sativa
MSPPLELDYIGLSPPVPAAADAAADNDLKGTELRLGLPGSHSPDRSPPAATLDLLPAAKGAKRGFSDEARPLPASAAAAAAAGKGKKAAAGEEDEDAEEEDKKVAAAPQAPAAKAQVVGWPPIRSYRKNTMATNQLKSSKEDAEAKQGQGFLYVKVSMDGAPYLRKVDLKTYKNYKDLSTALEKMFIGFTTGKDGLSESRKDGEYVLTYEDKDGDWMLVGDVPWEMFANSCRRLRIMKGSDAIGLAPRAVDKSKNRN

SEQ ID NO: 545 - DNA, 708 bp, Oryza sativa
atgtcgcccccactcgagctcgactacataggcctctcgccgccggtgcccgccgccgccgatgccgccgccgacaacgacctgaagggcaccgagctccgcctcggcctgcccggctcccactcgccggaccgctccccgcccgccgccacgctcgaccttctccccgctgccaagggcgccaagcgcgggttctccgacgaggcgcgtccgctgccggcgtccgccgccgccgccgccgccgccgggaagggcaagaaggcggcggccggcgaggaggatgaggatgcggaggaggaggacaagaaggtcgccgccgcgccgcaggcgcctgctgccaaggctcaggtggttggatggccaccaattcgcagctaccgcaagaacacgatggctactaaccagctgaagagcagcaaggaggatgctgaagcgaagcagggccaggggttcctgtacgtcaaggtcagcatggatggtgccccctacctcaggaaggtggacctcaagacctacaagaactacaaggacctgtcaactgcgcttgagaagatgttcattggcttcacaactggtgagatgtctcgggttaccctgcttgcatttctctttgtaattgcatttccttttgatgtggatgctcttacaattacatcgtctaggatgcctgtgactaggaaccaatatatgcttgatctgtacaagtaa

SEQ ID NO: 546 - protein, 235 aa, Oryza sativa
MSPPLELDYIGLSPPVPAAADAAADNDLKGTELRLGLPGSHSPDRSPPAATLDLLPAAKGAKRGFSDEARPLPASAAAAAAAGKGKKAAAGEEDEDAEEEDKKVAAAPQAPAAKAQVVGWPPIRSYRKNTMATNQLKSSKEDAEAKQGQGFLYVKVSMDGAPYLRKVDLKTYKNYKDLSTALEKMFIGFTTGEMSRVTLLAFLFVIAFPFDVDALTITSSRMPVTRNQYMLDLYK

SEQ ID NO: 547 - DNA, 846 bp, Oryza sativa
atgccgccgccgctcgaagcgcgagactacatcgggctcgcggcgtccccggcctcgtcctcctcctcctgctgcgcgtcgacccccgtcgccgaggtcgtcggggcgcacctcgcgctccgcctcggcctcccggggtcggagtcgcccgcccgcgctgaggcggaggctgtcgtcgtcgacgccgcgctcacgctcggccctgctcctcctcccaggggcggcgccaagcgcgggttcgtcgactccctcgaccgatccgagggccgtcgtgctgctgccaccgccggtgatgatgagaggggcgtgagggaggaggaggaggaggagaaggggttgggggaagctgctgctggagctccgcgagctgccaaggcacaagttgttggatggccacctgtgcgaagctaccggaagaatacattggccgccagtgccacaaagacaaagggggaagaccaaggcaaaagtgaggtaggatgttgctatgttaaggttagcatggatggagccccataccttaggaaggttgacctcaagacctattcaagctatgaagatctttcacttgctcttgagaagatgttcagctgctttatcactggtaggagcagttcacataaaacatcaaaaagagacaggctgactgatggttctagggctgatgcccttaaggaccaagagtatgttcttacctatgaagacaaggatgctgactggatgcttgttggtgatcttccttgggacttgtttactactagttgtcggaaactgcggatcatgagaggttcagatgctgctggaatggctccgagatcactggaacagacaggtcagaacaaatag

SEQ ID NO: 548 - protein, 281 aa, Oryza sativa
MPPPLEARDYIGLAASPASSSSSCCASTPVAEVVGAHLALRLGLPGSESPARAEAEAVVVDAALTLGPAPPPRGGAKRGFVDSLDRSEGRRAAATAGDDERGVREEEEEEKGLGEAAAGAPRAAKAQVVGWPPVRSYRKNTLAASATKTKGEDQGKSEVGCCYVKVSMDGAPYLRKVDLKTYSSYEDLSLALEKMFSCFITGRSSSHKTSKRDRLTDGSRADALKDQEYVLTYEDKDADWMLVGDLPWDLFTTSCRKLRIMRGSDAAGMAPRSLEQTGQNK

SEQ ID NO: 549 - DNA, 552 bp, Oryza sativa
atggagctcgagctcggcctcaggctcgcgctgccgtcgccgtcgccgtcgccggcgacggcgacggcggctgggagtgagcttgaccttctcaacagcgcgccggggtcctgccgcaagaggggcttcgaggaggcgctcggtgggttcaaaaccgacgacgacaacgacgacggcaatggccgcggcggtgacggcgattccgacggcgaaatgggcaacaagaggaggaagctggtggggtggccaccggtgaagtgcttgcaccggcggcgcgacggtggctgcggtggcggatatgtgaaggtgaagatggaggggttggccatcgggaggaagctggacttgtccatcctcggctcatacgctgagctgctcgacacgctccaccttatgttcccctccactaaccaagaggatgggcacgatcgtcgtcgacgtcacccatacgctgtcacctacgaggatggggaaggagactggatgcaggtcggagacgtgccatgggaggcctttgccaagtcggtgaaacggctcaagatactggtgtaa

SEQ ID NO: 550 - protein, 183 aa, Oryza sativa
MELELGLRLALPSPSPSPATATAAGSELDLLNSAPGSCRKRGFEEALGGFKTDDDNDDGNGRGGDGDSDGEMGNKRRKLVGWPPVKCLHRRRDGGCGGGYVKVKMEGLAIGRKLDLSILGSYAELLDTLHLMFPSTNQEDGHDRRRRHPYAVTYEDGEGDWMQVGDVPWEAFAKSVKRLKILV

SEQ ID NO: 551 - DNA, 801 bp, Oryza sativa
atggcgccgccacaggagcgggactacatcgggctgtcgccggcggcggcggcggcgctggcaacggagctgcgccttgggctgccggggactgcggaggaggctgagtcggagggcggcggaggaggagggacggatgcggctccgctgacgctcgagctgctgcccaagggcggggccaagcgcgggttcgcggacgccatcgttgggggtcccgccggccagcggcgggaggcggccgggggcaaggcggcggcggcggcggcggaggccgaggaggaggaggagaagaagaaggcgcaggcgccggcggcgaaggcacaggtggtaggatggccaccaatccgcagctacaggaagaacaccatggcgatgagccagcctgctctgaaaggcaaagacgacggcgaggcgaagcaggctccggcatccggttgcctctatgtcaaggtgagcatggatggtgctccttacctcaggaaggtggacctcaagatgtacaagaactacaaggagctctctttggctctggagaagatgttcagctgctttaccgtcggtcatggtgaatcaaatgggaagtcagggagagatggattatctgattgccgcctgatggatcttaaaaatggaacagaacttgtgctcacttatgaggacaaggatgaagattggatgcttgttggtgatgttccgtggcgaatgttcacagacagctgtaggaggctgaggattatgaaggggtcagatgcagtgggccttgctccaagagccactgacaagagcaaaaatcggaactga

SEQ ID NO: 552 - protein, 266 aa, Oryza sativa
MAPPQERDYIGLSPAAAAALATELRLGLPGTAEEAESEGGGGGGTDAAPLTLELLPKGGAKRGFADAIVGGPAGQRREAAGGKAAAAAAEAEEEEEKKKAQAPAAKAQVVGWPPIRSYRKNTMAMSQPALKGKDDGEAKQAPASGCLYVKVSMDGAPYLRKVDLKMYKNYKELSLALEKMFSCFTVGHGESNGKSGRDGLSDCRLMDLKNGTELVLTYEDKDEDWMLVGDVPWRMFTDSCRRLRIMKGSDAVGLAPRATDKSKNRN

SEQ ID NO: 553 - DNA, 450 bp, Oryza sativa
atgttcagagaaaaccgcgcggcttcatcagctcagctggtgggatggccaccggtgcgcacattccgcaagaacctgtccaccccaaaacctgcagatgcagatgacctgatgaacaagatgaagccctgctctgatgaaggccatggctccagagatgcagcccaagagaggaggccatcatcaaccatgtttgtgaaggtgaacctggagggctacgctgtcggaaggaagatcgacctgaaggcgcaccgcagctacgactcgctgtcccaggctctgcagagcatgttccatggcttcttgtcagatggcattgcaactagagacaatgagctgcagcggatggaggagggcagcaagaagaggtatgttcttgtgtatgaggataatgagggagaccgcatgctcgtcggcgacgtcccatgggagtacgtttgtttgctttga

SEQ ID NO: 554 - protein, 149 aa, Oryza sativa
MFRENRAASSAQLVGWPPVRTFRKNLSTPKPADADDLMNKMKPCSDEGHGSRDAAQERRPSSTMFVKVNLEGYAVGRKIDLKAHRSYDSLSQALQSMFHGFLSDGIATRDNELQRMEEGSKKRYVLVYEDNEGDRMLVGDVPWEYVCLL

SEQ ID NO: 555 - DNA, 582 bp, Oryza sativa
atgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaaggcgcgggcggtggggtggccgccggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagatgttcgtcgagtcctgcaagcggatccgtctcatgaagagctccgaggccgtcaacttatcgccaagacgatcatccagataa

SEQ ID NO: 556 - protein, 193 aa, Oryza sativa
MSTSSGADSSPPVSGLDYDDTALTLALPGSSSSSSSTADPERKRAAHADHADAKPPSPKARAVGWPPVRAYRRNALREDSARAKLVKVAVDGAPYLRKVDLAAHAGYAPLLRALHGMFASCLAVRGGGGGDGEGTKLVDLVTGAEYVPTYEDKDGDWMLVGDVPWKMFVESCKRIRLMKSSEAVNLSPRRSSR

SEQ ID NO: 557 - DNA, 501 bp, Oryza sativa
atgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaaggcgcgggcggtggggtggccgccggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagtaa

SEQ ID NO: 558 - protein, 166 aa, Oryza sativa
MSTSSGADSSPPVSGLDYDDTALTLALPGSSSSSSSTADPERKRAAHADHADAKPPSPKARAVGWPPVRAYRRNALREDSARAKLVKVAVDGAPYLRKVDLAAHAGYAPLLRALHGMFASCLAVRGGGGGDGEGTKLVDLVTGAEYVPTYEDKDGDWMLVGDVPWK

SEQ ID NO: 559 - DNA, 660 bp, Oryza sativa
atggcgtcttcttcttctctcaggagcaccagctgcctcgcctccgccgcggagaccgacgccgacaacctctgcctccgcctcggcccgccgggaagcagcatcaccaccaccaccaccaccggcggcgccgacccggcggcgaagaggtccctcggggcgaagcggtcgctggagagcacggacagcatggcctccggcaccggaacttccgccgccggcgacgagcacgacgacgacaccgccgcaccggccaaggcacaggtggtaggatggccaccagtgagggcataccggaggaacaccttccatcaggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggaaatgttcatctcttcctgcaagaagttgaggatcatgaagggctctgaagccaggtga

SEQ ID NO: 560 - protein, 219 aa, Oryza sativa
MASSSSLRSTSCLASAAETDADNLCLRLGPPGSSITTTTTTGGADPAAKRSLGAKRSLESTDSMASGTGTSAAGDEHDDDTAAPAKAQVVGWPPVRAYRRNTFHQAAAAAAATKKGGDEKQKQQQQGGGLYVKVSMDGAPYLRKVDLKMCKGYRELREALDLLFTKCFSATASDGCSDGQFAIAYEDKDGDLMLVGDVPWEMFISSCKKLRIMKGSEAR

SEQ ID NO: 561 - DNA, 606 bp, Oryza sativa
atggcgtcttcttcttctctcaggagcaccagctgcctcgcctccgccgcggagaccgacgccgacaacctctgcctccgcctcggcccgccgggaagcagcatcaccaccaccaccaccaccggcggcgccgacccggcggcgaagaggtccctcggggcgaagcggtcgctggagagcacggacagcatggcctccggcaccggaacttccgccgccggcgacgagcacgacgacgacaccgccgcaccggccaaggcacaggtggtaggatggccaccagtgagggcataccggaggaacaccttccatcaggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggagtaa

SEQ ID NO: 562 - protein, 201 aa, Oryza sativa
MASSSSLRSTSCLASAAETDADNLCLRLGPPGSSITTTTTTGGADPAAKRSLGAKRSLESTDSMASGTGTSAAGDEHDDDTAAPAKAQVVGWPPVRAYRRNTFHQAAAAAAATKKGGDEKQKQQQQGGGLYVKVSMDGAPYLRKVDLKMCKGYRELREALDLLFTKCFSATASDGCSDGQFAIAYEDKDGDLMLVGDVPWE

SEQ ID NO: 563 - DNA, 741 bp, Oryza sativa
atgaagagctcttcagttgcaccaaggctgaaacaggagagacaagatgactgtaagtttcaggaaggtgatgtgaacagccttgagcttcggcttggcatatcttccgacaatgaccagatcagtggtggtggtgctgctagtccatggcttggtgtgggagtgcacccttggagcctggctgcaaggcaagggaaggcagccttggagcaagctcaccagaggcctaatgaatgtgctgtccaaagagaaaaccgcgcggcttcatcagctcagctggtgggatggccaccggtgcgcgcattccgcaagaacctgtccaccccaaaacctgcagatgcagatgacctgatgaacaaggtgaagctctgctctgatgagggccatggctccagatgtgcagcccaagagaggaggtcatcatcaaccatgtttgtgaaggtgaacctggagggctatgctgtcggaaggaagatcgacctgaaggcgcaccgcagctatgactctctgtcccaggctctgcagagcatgttccatggcttcttgtcagatggcattgcaactagagacaatgagctgcagcagatggaggagggcagcaagaagaggtatgttcttgtgtatgaggataatgagggagaccgcatgctcgtcggcgacgtcccatgggagctgttcattgcttcagtgaagaggctctacattgctcaggatcctagagttcatgcgaagctacgataa

SEQ ID NO: 564 - protein, 246 aa, Oryza sativa
MKSSSVAPRLKQERQDDCKFQEGDVNSLELRLGISSDNDQISGGGAASPWLGVGVHPWSLAARQGKAALEQAHQRPNECAVQRENRAASSAQLVGWPPVRAFRKNLSTPKPADADDLMNKVKLCSDEGHGSRCAAQERRSSSTMFVKVNLEGYAVGRKIDLKAHRSYDSLSQALQSMFHGFLSDGIATRDNELQQMEEGSKKRYVLVYEDNEGDRMLVGDVPWELFIASVKRLYIAQDPRVHAKLR

SEQ ID NO: 565 - DNA, 423 bp, Oryza sativa
atggcgagctacggcgacgacggcgtggagctcaccgagctgacgctggggcctcccggagccagcgctcgcagggccaggcgcggcaggaagaacggccatccgccgccgtcgtcctcgatgattcaggcagcgtacttcgtgaaggtgagcatggacgggacgccgtacctgaggaaggtggacgtcgcggcgtacggcgactacctcgagctcgtcgaggcgctcaacgacatgttctactgctccaccattggactgatggacgggtacggcgagtgggagcacgccgtcgtgtacgaggacggcgacggcgactggatgctcgtcggcgacgtgccctgggagatgttcgtgtcttcgtgtaagaggatgagagtgatgcgagcttgtgaggcgagaggcttgagctcaaacgcgtga

SEQ ID NO: 566 - protein, 140 aa, Oryza sativa
MASYGDDGVELTELTLGPPGASARRARRGRKNGHPPPSSSMIQAAYFVKVSMDGTPYLRKVDVAAYGDYLELVEALNDMFYCSTIGLMDGYGEWEHAVVYEDGDGDWMLVGDVPWEMFVSSCKRMRVMRACEARGLSSNA

SEQ ID NO: 567 - DNA, 1056 bp, Oryza sativa
atgatgaatcttatatcatttgaaacacctcctcttgggaggaggagtcaagatggaggcagcagcagcagcagcatcactgctgctacaaccactaccaacaaggcaaaggaagcagcaagccatctagacctcagcctcggcatctccttgtcacccggcggcggcggcggcgacgctggcaccaaggccagcagctgctgctacggcggcggcggcgacggcggcggctgcatgggcagtggcatgctcactgcaggagttcttggcgttgggcatggggggagtagccatgacaatactacggcgagcagcggcggcggcggcagctggacggcggcgttcatgccgagcccgacgggattcatgcacccgtggagcctcgccgcccggcagcagaaggccgccgccgagcaggagcggagcggcgtcgcgaggctgccgccggcgacgacgacgtacatgccaagagctgccgcgaccgtgatttcactgccggcggcagttggctggccaccggtgcacacatcccggcgtaacctcgttgccaccataaataatgtcctgaaacccgacactactgccgccgtcaagccggacagaccgacacaagcaacggcgatgttcgccgccgacgaaaccacggcgcccccgccaaggagcgcggcggcggcgaccgaggccagcaggacattgaacatgtttgccaaggtgcacatggatgggtacaaggtgggcaggaagatcaacctcagggcacaccgcaactacgactccctccgtcgggtcctcaccaagatgactcataatttcttctgccccgcagattattcaagcacaaataagggagaagaagattgtgctaaaagtgacgagttcatatttctatatgaagattttgagggcgaccgaatgcttgttggcgatgtcccatgggagttgttccttgcatcagcaaaaaggttgtacattgccaaaaacccagcacccagaaacaaaggtacctacagacctcttgtctggatatgcatgctgcttccaaaagctccatattga

SEQ ID NO: 568 - protein, 351 aa, Oryza sativa
MMNLISFETPPLGRRSQDGGSSSSSITAATTTTNKAKEAASHLDLSLGISLSPGGGGGDAGTKASSCCYGGGGDGGGCMGSGMLTAGVLGVGHGGSSHDNTTASSGGGGSWTAAFMPSPTGFMHPWSLAARQQKAAAEQERSGVARLPPATTTYMPRAAATVISLPAAVGWPPVHTSRRNLVATINNVLKPDTTAAVKPDRPTQATAMFAADETTAPPPRSAAAATEASRTLNMFAKVHMDGYKVGRKINLRAHRNYDSLRRVLTKMTHNFFCPADYSSTNKGEEDCAKSDEFIFLYEDFEGDRMLVGDVPWELFLASAKRLYIAKNPAPRNKGTYRPLVWICMLLPKAPY

SEQ ID NO: 569 - DNA, 834 bp, Oryza sativa
atggcggcggacctggccttcgaggcgaccgagctccggctcggcctgcccggcggcggcggtgatggagacgccgcggcggcggcggcgaggagctcctccgggaagaggggcttcgccgagaccatcgacctcaagctgaagctggagccggcggccgcggcggtggacgacgacgacgacaaggaggaggcggcggctgacgaccgggagaagaaggtcgacatcgtcggagctgacaacgacgacgcctcgccgccggccgccgccgccgccggcgggatgaagcggtcgccgagccagagcagcgtcgtcaccgccgccgccgaccccgagaagccaagggctcccaaggcacaggtggttgggtggccgccggtccggtcataccggaagaacatcctggccgtgcaggccgacaagggcaaggacgccgccgacggcggcggcgacaagtccggcgccggcgccgccgccgccgccttcgtgaaggtgagcatggacggcgcgccatacctgcgcaaggtggacctcaagatgtacaagagctaccttgagctctccaaggcactcgagaagatgttcagctccttcaccattggaaactgtgggtctcatggggtgaacggcatgaacgagagcaagattgctgatctgctcaacggctctgaatatgtgccaacctacgaggacaaggacggcgactggatgctcgtcggcgacgtcccatgggagatgtttgttgaatcatgcaagcgccttaggataatgaaaggatcagaagctattggccttgcaccgagggcaatggagaaatgcaagaacagaagctga

SEQ ID NO: 570 - protein, 277 aa, Oryza sativa
MAADLAFEATELRLGLPGGGGDGDAAAAAARSSSGKRGFAETIDLKLKLEPAAAAVDDDDDKEEAAADDREKKVDIVGADNDDASPPAAAAAGGMKRSPSQSSVVTAAADPEKPRAPKAQVVGWPPVRSYRKNILAVQADKGKDAADGGGDKSGAGAAAAAFVKVSMDGAPYLRKVDLKMYKSYLELSKALEKMFSSFTIGNCGSHGVNGMNESKIADLLNGSEYVPTYEDKDGDWMLVGDVPWEMFVESCKRLRIMKGSEAIGLAPRAMEKCKNRS

SEQ ID NO: 571 - DNA, 594 bp, Oryza sativa
atggagaatctgaaggcgacggagctgaggctcgggctgccggggacggaggaggaggcggcgccgccgccgtcgacgcccagggccggaagcaagcgcgccctcgccggcgagcctgatcaggccaagatcaagcccgccgccgccgccaaggcgcaggtggtgggatggccgccggtgaggtcgtacaggaagagctgcctccagccgacgacgacgacgacgaagagcaagccgccgccggctgccgcggcggcggagacgcagcagaaggaggatgtcgccggcgccggtgggctgttcgtgaaggtgagcatggacggagctccatacctgaggaagatagacctcaaggtgtacaagggctaccgggagcttcgcgaggcactggaggccatgttcctctgcttctccggcggcgccgccgccgacgccgccgtcaacccgtccgacttcgccgtcacctacgaggacaaggacggcgacctcatgctcgtcggcgacgtcccattcgagatgttcattagtacgtgcaagaggttgaggatcatgaaggggtctgaagcaagaggcctaggagcaacaaggggttaa

SEQ ID NO: 572 - protein, 197 aa, Oryza sativa
MENLKATELRLGLPGTEEEAAPPPSTPRAGSKRALAGEPDQAKIKPAAAAKAQVVGWPPVRSYRKSCLQPTTTTTKSKPPPAAAAAETQQKEDVAGAGGLFVKVSMDGAPYLRKIDLKVYKGYRELREALEAMFLCFSGGAAADAAVNPSDFAVTYEDKDGDLMLVGDVPFEMFISTCKRLRIMKGSEARGLGATRG

SEQ ID NO: 573 - DNA, 546 bp, Oryza sativa
atgtcggtggagacggagcggagctccacggagtcgtccgccgcgtcggggctcgacttcgaggacaccgccctcaccctccgcctcccgggctccctcgccgccgccgccgcacctgaccccgaccgcaagcgctcctccccctcctcctccgacgccgccgacgccgcagacaactcctcccccctcgccgccgccgccgatgctccccctgctcccaaggcgagggtggtggggtggccgccggtgaggtcgttcaggaagaacgcgctggcggccaagttcgtgaaggtggccgtggacggcgcgccgtacctgcgcaaggtggacctcgaggcctactccggctacgaccagctcctccgcgcgctccaggacaagttcttctcccacttcaccatcccaattgacgggaggaaagttgcagggaagttcgccgacgacgagaggaagctggtggacgcggtgaacgggacggagtacgtgccgacgtacgaggacaaggacggcgactggatgctcgtcggcgacgtcccctggaagtga

SEQ ID NO: 574 - protein, 181 aa, Oryza sativa
MSVETERSSTESSAASGLDFEDTALTLRLPGSLAAAAAPDPDRKRSSPSSSDAADAADNSSPLAAAADAPPAPKARVVGWPPVRSFRKNALAAKFVKVAVDGAPYLRKVDLEAYSGYDQLLRALQDKFFSHFTIPIDGRKVAGKFADDERKLVDAVNGTEYVPTYEDKDGDWMLVGDVPWK

SEQ ID NO: 575 - DNA, 801 bp, Oryza sativa
atgtcgccgcccctcgagctcgactacataggcctctcgcctccgccgccgccgccctcctcctcctccgccgccgccgcccgcgcggacgacgtcgacctgaagggcaccgagctccgcctcggcctccctggctccgagtcgccggaccgccaccctgcggctattgccgctgccgctgccactgccaccacccttgagctgctgcccgccaagggtgccaagcgcgtgttccccgacgaggccgcgctgacgccgcccactgccgccgccgggaagggcaaggcggcgagggagggggaggaggtgggggctgaggaggaggacaagaaggtcgccgcgccgccgcagccggctgcgaaggctcaggtggtgggatggccaccaatccgcagctaccgcaagaacacgatggcaaccaaccagataaagagcaacaaggaggatgttgatgctaagcagggtcagggtttcctgtacgtcaaggttagcatggatggtgcaccatatctgaggaaggtggacctcaaaacttacaagaactacaaggacatgtctttgggtctcgagaaaatgttcattggcttcagcaccggtaaggaaggtgctgagaaccagaaagatggtgaatatgtgttaacctacgaagacaaggatggtgactggatgctggttggtgatgttccatgggagatgttcaccgactcttgccggaggctcagaatcatgaaaggctcagatgcaattggacttggctgttctcaactaaggcttgttccattatttgtgccaaagctttag

SEQ ID NO: 576 - protein, 266 aa, Oryza sativa
MSPPLELDYIGLSPPPPPPSSSSAAAARADDVDLKGTELRLGLPGSESPDRHPAAIAAAAATATTLELLPAKGAKRVFPDEAALTPPTAAAGKGKAAREGEEVGAEEEDKKVAAPPQPAAKAQVVGWPPIRSYRKNTMATNQIKSNKEDVDAKQGQGFLYVKVSMDGAPYLRKVDLKTYKNYKDMSLGLEKMFIGFSTGKEGAENQKDGEYVLTYEDKDGDWMLVGDVPWEMFTDSCRRLRIMKGSDAIGLGCSQLRLVPLFVPKL

SEQ ID NO: 577 - DNA, 585 bp, Oryza sativa
atggaggagtgcaagggcggtggcatgtcgccgtcctcctccatggatagcagcacccacccggcgctgtccacgacgtcgtcggcggcgacggcaaggcgggacctcagcaccgatctccggctagggcttagcctctcgacgtcgtcgtcgtcctccctcctgcaggccgccgccgccgccgccgctgctgatgatagcatcccttctactccaaggaacagccaagtgcacgccgattggccgccgatcaagccgttcctcaggagcgccttgcagaaggcgtcggccgctggcggcggcggcgctcgccgacggcgaacgctgttcgtgaaggtgtacatggagggcgtcccgatcggccggaagctcgacctgctcttgctggatgggtatgacagcctcctcatcaagctctgccacatgttcaagacgcccatcacctatgctgatgttatggagtgccatcaacaagttcctggccagaaggctgcccatgtcctcacctatgaagaccaggacggggactggatgatgactcttcctgagcagcgtaaagaagctcaggattgcaaggatggataa

SEQ ID NO: 578 - protein, 194 aa, Oryza sativa
MEECKGGGMSPSSSMDSSTHPALSTTSSAATARRDLSTDLRLGLSLSTSSSSSLLQAAAAAAAADDSIPSTPRNSQVHADWPPIKPFLRSALQKASAAGGGGARRRRTLFVKVYMEGVPIGRKLDLLLLDGYDSLLIKLCHMFKTPITYADVMECHQQVPGQKAAHVLTYEDQDGDWMMTLPEQRKEAQDCKDG

SEQ ID NO: 579 - DNA, 735 bp, Oryza sativa
atgtcgcctcccctcgagccgcacgactacatcggcctctccgctgcggcggcgtccccgacgccgagctcgtcgtcctgctcgtcctcgccgaacccaggcggcgaggcccgcggcccacgcctcacgctccgcctcggcctcccggggtcggagtcccccgagcgggaggtcgtcgccgcggggctcaccctcgggcctctgcccccgaccaccaccaaggcggcctccaagcgcgccttccccgactcctccccgcggcacggcgccagctccggctccgtcgccgccgccgccgcagcttgccaggacaaggcggcccccgccgccgctccgccggctgcaaaggcgcaggtggtgggatggccgcccgtgcggaactaccgaaagaacacgctggcggcgagcgcctccaagggcaaaggggaggacaagggcacggctgaagggggccctctctatgtcaaggtgagcatggatggagccccctacctcaggaaggtcgacctcaagatgtattctagctatgaggacctctccatggctctcgagaagatgttcagctgcttcatcactggtcaaagcggtttgcgtaaatcatcaaacagagataggcttactaatggttcaaaggctgatgccctccaagaccaagagtatgtccttacatatgaagataaggatgctgactggatgcttgttggtgatcttccttgggaatcgaagcaggactag

SEQ ID NO: 580 - protein, 244 aa, Oryza sativa
MSPPLEPHDYIGLSAAAASPTPSSSSCSSSPNPGGEARGPRLTLRLGLPGSESPEREVVAAGLTLGPLPPTTTKAASKRAFPDSSPRHGASSGSVAAAAAACQDKAAPAAAPPAAKAQVVGWPPVRNYRKNTLAASASKGKGEDKGTAEGGPLYVKVSMDGAPYLRKVDLKMYSSYEDLSMALEKMFSCFITGQSGLRKSSNRDRLTNGSKADALQDQEYVLTYEDKDADWMLVGDLPWESKQD

SEQ ID NO: 581 - DNA, 870 bp, Oryza sativa
atggagctggagcttgggctggcgccaccgaattccggtcatctcgtcgtcgacgagctcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctgtcgacgacgcggagcctgaatcttctcccggagaacgcccgggtgagctgcagagactacaagaagatgctcgacagcggcaggccgcacctgctggtggacgtgcggccgtcgcaccattttctgatagcgtccatggctcactccatcaacgtcccgctctcgctgctggaggagaagctgccactgctgcgggactcggcgagggaagtgtcgtcgcggcgcgacgggcggcagcactgccctgtgtacgtcatctgccggcgaggcaatgactcccaggtcgccgtgcagatcctccgcgagaatgggttcctgtatgcgagcgacgtcgccggtgggtttgagtcctgggccaaggaagtcgaccccagcttccttctctactag

SEQ ID NO: 582 - protein, 289 aa, Oryza sativa
MELELGLAPPNSGHLVVDELSSSSGGGSGSAPVSASSAGKRGFREAFQETLLLFDDGSCCNTSDDDCRRRKKTVVGWPPVSSARRACGGANYVKVKKEGDAIGRKVDLALHSSYDELAATLARMFPTNDHQGEKKMANDDHGDAAGPVVTYEDGDGDWMLSTTRSLNLLPENARVSCRDYKKMLDSGRPHLLVDVRPSHHFLIASMAHSINVPLSLLEEKLPLLRDSAREVSSRRDGRQHCPVYVICRRGNDSQVAVQILRENGFLYASDVAGGFESWAKEVDPSFLLY

SEQ ID NO: 583 - DNA, 543 bp, Oryza sativa
atggagctggagcttgggctggcgccaccgaattccggtcatctcgtcgtcgacgagctcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctggttggggacgtgccatgggatgattttgcacgatctgtgaaacgcctgaagatactgggttaa

SEQ ID NO: 584 - protein, 180 aa, Oryza sativa
MELELGLAPPNSGHLVVDELSSSSGGGSGSAPVSASSAGKRGFREAFQETLLLFDDGSCCNTSDDDCRRRKKTVVGWPPVSSARRACGGANYVKVKKEGDAIGRKVDLALHSSYDELAATLARMFPTNDHQGEKKMANDDHGDAAGPVVTYEDGDGDWMLVGDVPWDDFARSVKRLKILG

SEQ ID NO: 585 - DNA, 807 bp, Oryza sativa
atgagaggaggagcagctgggcccaccgccggcgagccgccggggacggaggcggaggcggaggaagtggaggagagctcagctggggacgacgaggagctggagctcgggctcagccttggctccaagaaacagcagcagcagcagcatgcgccgtgccgaatcctgacggccagggacctgcagccggcggcggcgctgtcaccggactcctccgtgtcgtcgtcatcccccgcggcggcggcggcgggggggaagagggctgagggccccaccgccaccacctcgcctgggacggttgcttccggccatccacacagcagctttggagtggtgggatggccaccgatccgacagttcaggatgaacagcctgttcaatcaggctaaagaaaacacatctgaaaccgacaccaagaagaccgccaccaatgaatctgatgtgcagaaggacaaggaggagggcgaaaagaaaggacgggttgctggatgggtgaaggtgaacatggatggagaggtcattggaaggaaggacaatgagatagttttgcaaattaaaataatagccatgcttcatattgtacctaataatacaaagtcgctgaaactactagacaactctgccgaataccagctcacctacgaggacagggatggtgactggatgctcgttggagatgttccttgggaaatgtttgtcagctctgtgaagaggttgaggatcatgaggacatcagatgcgaatggtcttggtcagcgataccagggaattcacagaaccattgcttcaacaagaggcagatcctga

SEQ ID NO: 586 - protein, 268 aa, Oryza sativa
MRGGAAGPTAGEPPGTEAEAEEVEESSAGDDEELELGLSLGSKKQQQQQHAPCRILTARDLQPAAALSPDSSVSSSSPAAAAAGGKRAEGPTATTSPGTVASGHPHSSFGVVGWPPIRQFRMNSLFNQAKENTSETDTKKTATNESDVQKDKEEGEKKGRVAGWVKVNMDGEVIGRKDNEIVLQIKIIAMLHIVPNNTKSLKLLDNSAEYQLTYEDRDGDWMLVGDVPWEMFVSSVKRLRIMRTSDANGLGQRYQGIHRTIASTRGRS

SEQ ID NO: 587 - DNA, 420 bp, Oryza sativa
atgtcgatcagggcgcaggtggtggggtggccgccggtccggtcgttcaggaagaacgtgctcgccgagaaatgcaaggcggcggcgctggtgaaggtgagcatggacggcgcgccgtacctgaggaagatcgacgtcgccatgtacaagagctacccggagttgtccatggcgttccagaacatgttcacctccttcaccatcggcaagtgtgggtcccatcagcagctgaaggagagcaataagctgagagatgacctggagtacgtgccgacgtacgaggacaaggacggcgactggatgctcgtcggcgacgtcccgtgggagatgttcgtcgagtcgtgcaaacgcctccgaatcatgaaagggtctgaagccattggccttgcaccaagggcagtggagaaatgcaagagctga

SEQ ID NO: 588 - protein, 139 aa, Oryza sativa
MSIRAQVVGWPPVRSFRKNVLAEKCKAAALVKVSMDGAPYLRKIDVAMYKSYPELSMAFQNMFTSFTIGKCGSHQQLKESNKLRDDLEYVPTYEDKDGDWMLVGDVPWEMFVESCKRLRIMKGSEAIGLAPRAVEKCKS

SEQ ID NO: 589 - DNA, 681 bp, Oryza sativa; identical to SEQ ID NO: 523

SEQ ID NO: 590 - protein, 226 aa, Oryza sativa; identical to SEQ ID NO: 524

SEQ ID NO: 591 - DNA, 285 bp, Oryza sativa
atggacggggcgccgtacctgaggaagatcgacctgaggatgtacaagggctacagggagctccgcgaggccctggaggccatgttcgtctgcttctccggcgccgccgacggcgccaacccgtcggagttcgccatcacctaccaggacaaggacggggacctcatgctcgtcggcgacgtccctttcgacatgttcaccagcacatgcaagaagttgaggatcatgaagagatctgaagccacaggggctaggatcaccaaggcaaatgaagatctaatctaa

SEQ ID NO: 592 - protein, 94 aa, Oryza sativa
MDGAPYLRKIDLRMYKGYRELREALEAMFVCFSGAADGANPSEFAITYQDKDGDLMLVGDVPFDMFTSTCKKLRIMKRSEATGARITKANEDLI

SEQ ID NO: 593 - DNA, 711 bp, Oryza sativa; identical to SEQ ID NO: 525

SEQ ID NO: 594 - protein, 236 aa, Oryza sativa; identical to SEQ ID NO: 526

SEQ ID NO: 595 - DNA, 588 bp, Oryza sativa
atggcggcggagagcatcgacgcggagctgcgcctcgggctgcccggcagcggcggcggtgacggcgtggcggcgaagaagcggcggtcggcgtcgtcgacggtgaagagcgaggcctccggcacggcctgctgcggcggcgccggcgcccgggacgtcgaagacggcgcctcgccggcgtccaaagtgcaggtggtggggtggccgccggtggggtcgtacaggaggagcacgttccagtcgtcgtcgtcgtcgacggcggcggcggcgaaggggaagggcggcggcgagacggatcaagggaggaagaataagggaggagggctgtacgtgaaggtgagcatggacggggcgccatacctccgcaaggtcgacctccggatgtacggcggctacagggagctcagggacgctctcgacgcgctcttcggctgcttctccgccgacgcctccgcctccgccgcccacttcgccgtcgcctatgaggacaaggacggcgacctcatgctcgccggcgacgtgccctgggacatgttcatctcttcttgcaagaagctgcggataatgcgaggatctgaggcgagatga

SEQ ID NO: 596 - protein, 195 aa, Oryza sativa
MAAESIDAELRLGLPGSGGGDGVAAKKRRSASSTVKSEASGTACCGGAGARDVEDGASPASKVQVVGWPPVGSYRRSTFQSSSSSTAAAAKGKGGGETDQGRKNKGGGLYVKVSMDGAPYLRKVDLRMYGGYRELRDALDALFGCFSADASASAAHFAVAYEDKDGDLMLAGDVPWDMFISSCKKLRIMRGSEAR

SEQ ID NO: 597 - DNA, 597 bp, Oryza sativa
atgtcggtggagacggagcggagctcgacggagtcgtcggcggcgtccgggctcgacttcgaggacaccgccctcaccctccgcctcccgggctcctcctcctcctcctcctcctcgtcatcctcctcctcctcgtcgccgtcggagcccgaccgcaagcgcgcctccgccaccgacgacgaccccgacaaccgcctcggctccaccgccaccgagtcccccccttcccccaagttgcagcctgacatggcgcgtcgcggcgggcgcagggcgcgggtggtcgggtggccgccggtgcgcgcgttccggaagaacgcgctcgcggcgtcggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccgcaagctcgggaacgaggagatgaagctcgtcgacgcggtgagcggcaacgagtacgtgccgacgtacgaggacaaggacggcgactggatgctcgtcggagacgtcccctggaagtga

SEQ ID NO: 598 - protein, 198 aa, Oryza sativa
MSVETERSSTESSAASGLDFEDTALTLRLPGSSSSSSSSSSSSSSSPSEPDRKRASATDDDPDNRLGSTATESPPSPKLQPDMARRGGRRARVVGWPPVRAFRKNALAASAAASSSKAKFVKVAVDGAPYLRKVDLEAYRGYDQLLAALQDKFFSHFTIRKLGNEEMKLVDAVSGNEYVPTYEDKDGDWMLVGDVPWK

SEQ ID NO: 599 - DNA, 1569 bp, Oryza sativa
atggggaaatgttataacaacgcctccaagaacggtaataacgcctcaggtgtcaccatcgtcaagctggcccaatggcctgacaaggctttcgccaacagttccccattcaacaccatgaaaccaacccgtacaacgacgcttgctagaacaccgcaccatcccttcagcaaccaagcccaggccatcaccccatgctcaggcgtgctcacacaagactgctatcccacagtgggtttcccaaccaaaaagccacaaatattaatttcctctcctacccctgccggcaacgcgtctctctgctccctctctcttgtcgccgctctctctgctctctccctctctctcagcaaagcggacggcgagccacgcgggtcgcggcggcggacggccctgccccaccccgctgccggcatcgaagcggcggcatcgacggggcacggggcgagatctgggtgcgcgtcgccacccctctccctttgcccgtcgccaacctccccgccgccgcccgtcgcaccgttgccgtcgccgtggtgtccagatctggtcggccgcgccgtcgccgtcgtgggtggatctgggcgcggatccggggctagatccgcgccgcatcgagacggacgtggcgccggcggagatcagggaggacgacgactcttccacctcgccggtgtcggatccgctctttccccctctcttccccgccgccgctcgtcgccgtccacctcgtcggcgcggcctccagctcctccaccacctcgagctctagccaagggtgttacgggaaatacgggtgtggggaacagtgtccacaagctacgagacagagagagagagatggcttggaatggcaggtttggagaggatggagaggaagagaggagccttgagctcagccttgccctccctggatacttctccagctcaggtttgcaggggaacacgagcactgctgctgatggagccaagggaaacgatgggttcaaggcaagcaaaaagatgctaaaatttgcccctaaattctctgcgattcgcagcaggccggcggctccggtggtcgggtggccgccggtgcggtcgttccggcggaacctcgcctcgtcgtcgtcgtcgtcgaagccgccgcgtggaggccgagacgccgccgccgccgccacgggaggcaaggtggcccggttcgtcaaggtgaacatggacggcgtcccgatcggccggaaggtcgacctggcggcgcacggcggctacggcgagctctccgccgccgtcgaccgtctcttccgcggcctcctcgccgctcaaagggacccaaccatggccaccgccgccgccgccgccgctgccggcgagagctgcacaggagaggaggaggcgatcgccgggctcctcgacggcggcagcggcgagtacacgctcgtctacgaggacgacgagggcgaccagatgctcgtcggcgacgtgccatggaacatgttcatcgccgcggcgaggaggctgcgcgtgctcaggagctccgacctgaacgcctccacgatacgagcagggagcaggaagagggcagctgccgagtga

SEQ ID NO: 600 - protein, 522 aa, Oryza sativa
MGKCYNNASKNGNNASGVTIVKLAQWPDKAFANSSPFNTMKPTRTTTLARTPHHPFSNQAQAITPCSGVLTQDCYPTVGFPTKKPQILISSPTPAGNASLCSLSLVAALSALSLSLSKADGEPRGSRRRTALPHPAAGIEAAASTGHGARSGCASPPLSLCPSPTSPPPPVAPLPSPWCPDLVGRAVAVVGGSGRGSGARSAPHRDGRGAGGDQGGRRLFHLAGVGSALSPSLPRRRSSPSTSSARPPAPPPPRALAKGVTGNTGVGNSVHKLRDREREMAWNGRFGEDGEEERSLELSLALPGYFSSSGLQGNTSTAADGAKGNDGFKASKKMLKFAPKFSAIRSRPAAPVVGWPPVRSFRRNLASSSSSSKPPRGGRDAAAAATGGKVARFVKVNMDGVPIGRKVDLAAHGGYGELSAAVDRLFRGLLAAQRDPTMATAAAAAAAGESCTGEEEAIAGLLDGGSGEYTLVYEDDEGDQMLVGDVPWNMFIAAARRLRVLRSSDLNASTIRAGSRKRAAAE

SEQ ID NO: 601 - DNA, 774 bp, Oryza sativa; identical to SEQ ID NO: 543

SEQ ID NO: 602 - protein, 257 aa, Oryza sativa; identical to SEQ ID NO: 544

SEQ ID NO: 603 - DNA, 879 bp, Oryza sativa
atggaagaagaattcaaggacaaaggcctccctcccacgctgctacacctcatccctgacgggagagaatggaaggtgaaagaagcagatggagaaggatcaaggaacacaaacttagatgccgatgaggataaggagctagagcttaagctcggcctccctggtgtccaacaggaagagagagcagctgattcaagagagaagatacagcagcaacaacgagagagttcctcagaaccatccatcggttgcttccctacacattcaaagcctaccaccagcatcggcacaactggggcaaagagaggattttttgcgactgttggggccacactagaaggttataatcagagccaccgggacacagaagaatgtgggaaggagctaacgttaggagatgaaaatatggcaggtgagaggaagaaaggatgctgtccctcaccaccatgctcagctgcagcgcacagcagcaacccccaggggagaggtgctattcctccagtagtcggttggcctccaatccggtccttcaggagaaacctcacaaatggcagttcatttaaacagtcccctgaacgacaaaatgacgaagctgatgacaaggcaaagccaatctgcaagaagagacctcttgtcaaaatcaacatggatgggatccccattggaaggaaagtagaccttgaaatatacgacagctaccagaagctgtcatctgctgttgaagagttgttccgtggttttcttgaagacaatgatggagacagaatgttagctggggacataccatggaaggtatttgtttcgactgttaagaggttgagggttatgaggaggtcagaacttccccatgacatgattggagctgaccctgtgaagtag

SEQ ID NO: 604 - protein, 292 aa, Oryza sativa
MEEEFKDKGLPPTLLHLIPDGREWKVKEADGEGSRNTNLDADEDKELELKLGLPGVQQEERAADSREKIQQQQRESSSEPSIGCFPTHSKPTTSIGTTGAKRGFFATVGATLEGYNQSHRDTEECGKELTLGDENMAGERKKGCCPSPPCSAAAHSSNPQGRGAIPPVVGWPPIRSFRRNLTNGSSFKQSPERQNDEADDKAKPICKKRPLVKINMDGIPIGRKVDLEIYDSYQKLSSAVEELFRGFLEDNDGDRMLAGDIPWKVFVSTVKRLRVMRRSELPHDMIGADPVK

SEQ ID NO: 605 - DNA, 966 bp, Oryza sativa
atgccgccgccgctcgaagcgcgagactacatcgggctcggggcgaccccggcctcgtcctcctcctcctgctgcgcgtcgacccccgtcgccgaggtcgtcggggcgcacctcgcgctccgcctcggcctcccggggtcggagtcgcccgcccgcgctgaggcggaggctgtcgtcgtcgacgccgcgctcacgctcggccctgctcctcctcccaggggcggcgccaagcgcgggttcgtcgactccctcgaccgatccgagggccgtcgtgctgctgccaccgccggtgatgatgagaggggcgtgagggaggaggaggaggaggaggagaaggggttgggggaagctgctgctggagctccgcgagctgccaaggcacaagttgttggatggccacctgtgcgaagctaccggaagaatacattggccgccagtgccacaaagacaaagggggaagaccaaggcaaaagtgaggtaggatgttgctatgttaaggtcagcatggatggagccccataccttaggaaggttgacctcaagacctattcaagctatgaagatctttcacttgctcttgagaagatgttcagctgctttatcactggtaggagcagttcacataaaacatcaaaaagagacaggctgactgatggttctagggctgatgcccttaaggaccaagagtatgttcttacctatgaagacaaggatgctgactggatgcttgttggtgatcttccttgggacttgtttactactagttgtcggaaactgcggatcatgagaggttcagatgctgctggaattgcctcagataacttgagtaacggtaactcgtatcttctgtgtccctgcagctccgagatcactggaacagacaggtcagaacaaatagttgcccgagctttcatcatctggacagcaaatgtgtggaccaagtttgctgtagcaagtttccgctga

SEQ ID NO: 606 - protein, 321 aa, Oryza sativa
MPPPLEARDYIGLGATPASSSSSCCASTPVAEVVGAHLALRLGLPGSESPARAEAEAVVVDAALTLGPAPPPRGGAKRGFVDSLDRSEGRRAAATAGDDERGVREEEEEEEKGLGEAAAGAPRAAKAQVVGWPPVRSYRKNTLAASATKTKGEDQGKSEVGCCYVKVSMDGAPYLRKVDLKTYSSYEDLSLALEKMFSCFITGRSSSHKTSKRDRLTDGSRADALKDQEYVLTYEDKDADWMLVGDLPWDLFTTSCRKLRIMRGSDAAGIASDNLSNGNSYLLCPCSSEITGTDRSEQIVARAFIIWTANVWTKFAVASFR

SEQ ID NO: 607 - DNA, 591 bp, Oryza sativa
atggcgccgccacaggagcgggactacatcgggctgtcgccggcggcggcggcggcgctggcaacggagctgcgccttgggctgccggggactgcggaggaggctgaggcacaggtggtaggatggccaccaatccgcagctacaggaagaacaccatggcgatgagccagcctgctctgaaaggcaaagacgacggcgaggcgaagcaggctccggcatccggttgcctctatgtcaaggtgagcatggatggtgctccttacctcaggaaggtggacctcaagatgtacaagaactacaaggagctctctttggctctggagaagatgttcagctgctttaccgtcggtcatggtgaatcaaatgggaagtcagggagagatggattatctgattgccgcctgatggatcttaaaaatggaacagaacttgtgctcacttatgaggacaaggatgaagattggatgcttgttggtgatgttccgtggcgaatgttcacagacagctgtaggaggctgaggattatgaaggggtcagatgcagtgggccttgctccaagagccactgacaagagcaaaaatcggacctga

SEQ ID NO: 608 - protein, 196 aa, Oryza sativa
MAPPQERDYIGLSPAAAAALATELRLGLPGTAEEAEAQVVGWPPIRSYRKNTMAMSQPALKGKDDGEAKQAPASGCLYVKVSMDGAPYLRKVDLKMYKNYKELSLALEKMFSCFTVGHGESNGKSGRDGLSDCRLMDLKNGTELVLTYEDKDEDWMLVGDVPWRMFTDSCRRLRIMKGSDAVGLAPRATDKSKNRT

SEQ ID NO: 609 - DNA, 504 bp, Oryza sativa
atgttcagagaaaaccgcgcggcttcatcagctcagctggtgggatggccaccggtgcgcgcattccgcaagaacctgtccaccccaaaacctgcagatgcagatgacctgatgaacaagatgaagccctgctctgatgaaggccatggctccagagatgcagcccaagagaggaggccatcatcaaccatgtttgtgaaggtgaacctggagggctacgctgtcggaaggaagatcgacctgaaggcgcaccgcagctacgactcgctgtcccaggctctgcagagcatgttccatggcttcttgtcagatggcattgcaactagagacaatgagctgcagcggatggaggagggcagcaagaagaggtatgttcttgtgtatgaggataatgagggagaccgcatgctcgtcggcgacgtcccatgggagtacctgttcattgcttcagtgaagaggctctacattgctcaggatcctagagttcatgggaagctacgataa

SEQ ID NO: 610 - protein, 167 aa, Oryza sativa
MFRENRAASSAQLVGWPPVRAFRKNLSTPKPADADDLMNKMKPCSDEGHGSRDAAQERRPSSTMFVKVNLEGYAVGRKIDLKAHRSYDSLSQALQSMFHGFLSDGIATRDNELQRMEEGSKKRYVLVYEDNEGDRMLVGDVPWEYLFIASVKRLYIAQDPRVHGKLR

SEQ ID NO: 611 - DNA, 585 bp, Oryza sativa
atgtcgacgagctccggcgccgactcgtccccgcccgtctcgggcctcgactacgacgacaccgccctaaccctcgccctccccggctcctcctcctcctcctcctcctccaccgccgaccccgaacgcaagcgcgccgcccacgccgaccacgccgacgccaagccgccttccccaaaggcgcgggcggtggggtggccgccggtgagggcgtacaggcggaacgcgctgcgggaggacgccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcgccggcggcgacggcgagggtacaaagctcgtcgacttggtcaccggcgccgagtacgtgcccacctacgaggacaaggacggcgactggatgctcgtcggcgacgtcccctggaagatgttcgtcgagtcctgcaagcggatccgtctcatgaagagctccgaggccgtcaacttatcgccaagacgatcatccagataa

SEQ ID NO: 612 - protein, 194 aa, Oryza sativa
MSTSSGADSSPPVSGLDYDDTALTLALPGSSSSSSSSTADPERKRAAHADHADAKPPSPKARAVGWPPVRAYRRNALREDAARAKLVKVAVDGAPYLRKVDLAAHAGYAPLLRALHGMFASCLAVRGGAGGDGEGTKLVDLVTGAEYVPTYEDKDGDWMLVGDVPWKMFVESCKRIRLMKSSEAVNLSPRRSSR

SEQ ID NO: 613 - DNA, 822 bp, Oryza sativa
atggcgtcttcttcttctctcaggagcaccagctgcctcgcctccgccgcggagaccgacgccgacaacctctgcctccgcctcggcccgccgggaagcagcatcaccaccaccaccaccatcggcggcgccgacccggcggcgaagaggtccctcggggcgaagcggtcgctggagagcacggacagcatggcctccggcaccggaaattccgccgccggcgacgagcacgacgacgacaccgccgcaccggccaaggcacaggtggtaggatggccaccagtgagggcataccggaggaacaccttccatcaggtcgctgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggaaatgttcatctcttcctgcaagaagttgaggatcatgaagggctctgaagccagcaagatttatgccttgaagaccaatcaagtgcttaacctgcaggccattggttcaaactctgaagaagataaggcccttgcctggctgcctgcccacactgccaaccaagcagatgcagatgcacggatgaatcagcacaaactccgtggaagaattacctcgaaaaaataa

SEQ ID NO: 614 - protein, 273 aa, Oryza sativa
MASSSSLRSTSCLASAAETDADNLCLRLGPPGSSITTTTTIGGADPAAKRSLGAKRSLESTDSMASGTGNSAAGDEHDDDTAAPAKAQVVGWPPVRAYRRNTFHQVAAAATKKGGDEKQKQQQQGGGLYVKVSMDGAPYLRKVDLKMCKGYRELREALDLLFTKCFSATASDGCSDGQFAIAYEDKDGDLMLVGDVPWEMFISSCKKLRIMKGSEASKIYALKTNQVLNLQAIGSNSEEDKALAWLPAHTANQADADARMNQHKLRGRITSKK

SEQ ID NO: 615 - DNA, 612 bp, Oryza sativa
atgggtcatgaacacgcgccccttgaatgtcgtctgcaaataaaaccagagcaacttgaggacactgaatggcatcagaacgagcactcactgttaaagaagaaaacagtgaaaacattaccttttccaagaagtagggcagagaagcggcatggtccaagtgaaagctgcaaatttgaagggcgaagttacacagaagggaggaacacgacggttagcatggatgctgcaccatatctgaggaaggtggacctcaaaacttacaagaattacaaggacatgtctttgggtctcgagaaaatgttcattggcttcagcaccggagaggccgacgaggaaccccacgtgccgacggaggccgaggacgagaggcgcgccggcggctgcgagctgagcctccttgcggcagagaccgagtatgacgcgcgcgtcgatggacgccggcccgtcaagctcacgagctgggcctcagcgccggacttgtgcaagaagatggcgaaggtcggggagcagcagccggcgctggacttgcgcgagaagatggcgagcgcggtggccggactcgtcgtcttggaacgacacccacaaaatatatggcgagtctgcatgtag

SEQ ID NO: 616 - protein, 203 aa, Oryza sativa
MGHEHAPLECRLQIKPEQLEDTEWHQNEHSLLKKKTVKTLPFPRSRAEKRHGPSESCKFEGRSYTEGRNTTVSMDAAPYLRKVDLKTYKNYKDMSLGLEKMFIGFSTGEADEEPHVPTEAEDERRAGGCELSLLAAETEYDARVDGRRPVKLTSWASAPDLCKKMAKVGEQQPALDLREKMASAVAGLVVLERHPQNIWRVCM

SEQ ID NO: 617 - DNA, 741 bp, Oryza sativa
atgaagagctcttcagttgcaccaaggctgaaacaggagagacaagatgactgtaagtttcaggaaggtgatgtgaacagccttgagcttcggcttggcatatcttccgacaatggccagatcagtggtggtggtgctgctagtccatggcttggtgtgggagtgcacccttggagcctggctgcaaggcaagggaaggcagccttggagcaagctcaccagaggcctaatgaatgtgctgtccaaagagaaaaccgcgcggcttcatcagctcagctggtgggatggccaccggtgcgcgcattccgcaagaacctgtccaccccaaaacctgcagatgcagatgacctgatgaacaaggtgaagctctgctctgatgagggccatggctccagatgtgcagcccaagagaggaggtcatcatcaaccatgtttgtgaaggtgaacctggagggctatgctgtcggaaggaagatcgacctgaaggcgcaccgcagctatgactctctgtcccaggctctgcagagcatgttccatggcttcttgtcagatggcattgcaactagagacaatgagctgcagcagatggaggagggcagcaagaagaggtatgttcttgtgtatgaggataatgagggagaccgcatgctcgtcggcgacgtcccatgggagctgttcattgcttcagtgaagaggctctacattgctcaggatcctagagttcatgcgaagctacgataa

SEQ ID NO: 618 - protein, 246 aa, Oryza sativa
MKSSSVAPRLKQERQDDCKFQEGDVNSLELRLGISSDNGQISGGGAASPWLGVGVHPWSLAARQGKAALEQAHQRPNECAVQRENRAASSAQLVGWPPVRAFRKNLSTPKPADADDLMNKVKLCSDEGHGSRCAAQERRSSSTMFVKVNLEGYAVGRKIDLKAHRSYDSLSQALQSMFHGFLSDGIATRDNELQQMEEGSKKRYVLVYEDNEGDRMLVGDVPWELFIASVKRLYIAQDPRVHAKLR

SEQ ID NO: 619 - DNA, 423 bp, Oryza sativa; identical to SEQ ID NO: 565

SEQ ID NO: 620 - protein, 140 aa, Oryza sativa; identical to SEQ ID NO: 566

SEQ ID NO: 621 - DNA, 435 bp, Oryza sativa
atgttcgccgccgacgaaaccacggcgcccccgccaaggagcgcggcggcggcggcgaccgaggccagcaggacattgaacatgtttgccaaggtgcacatggatgggtacaaggtgggcaggaagatcaacctcagggcacaccgcaactacgactccctccgtcgggtcctcaccaagatgactcataatttcttctgccccacagattattcaagcacaaataagggagaagaagattgtgctaaaagtgacgagttcatatttctatatgaagattttgagggtgaccgaatgcttgttggcgatgtcccatgggagttgttccttgcatcagcaaaaaggttgtacattgccaaaaacccagcacccagaaacaaagaacatgctgaaatcgccaaaaggaaagaaactgaagatgcaatagataactga

SEQ ID NO: 622 - protein, 144 aa, Oryza sativa
MFAADETTAPPPRSAAAAATEASRTLNMFAKVHMDGYKVGRKINLRAHRNYDSLRRVLTKMTHNFFCPTDYSSTNKGEEDCAKSDEFIFLYEDFEGDRMLVGDVPWELFLASAKRLYIAKNPAPRNKEHAEIAKRKETEDAIDN

SEQ ID NO: 623 - DNA, 834 bp, Oryza sativa; identical to SEQ ID NO: 569

SEQ ID NO: 624 - protein, 277 aa, Oryza sativa; identical to SEQ ID NO: 570

SEQ ID NO: 625 - DNA, 594 bp, Oryza sativa; identical to SEQ ID NO: 571

SEQ ID NO: 626 - protein, 197 aa, Oryza sativa; identical to SEQ ID NO: 572

SEQ ID NO: 627 - DNA, 255 bp, Zea mays
  misc_feature (17)..(17): n is a, c, g, or t
aaagcagggctggtacncggtccggaattcccgggatctccactccaaacaaacaagggacggtgagcgaggaaccccaccccacgtcgccctccccccacctttctctctagtctctagtttctagtctctacccccaggccccagactcctgcctcttctctctctcgcccacccgccccggccccaatgtcgccgcccctcgagccccacgactacatcggcctctccgccgccgccgccgcggcgccgccg

SEQ ID NO: 628 - protein, 120 aa, Zea mays
MYVKVSMDGAPYLRKVDIKMYSSYEDLSVALQKMFSCFIAGQSGLHKSSSKDRLTNGSKVDALKDQEYVLTYEDKDADWMLVGDLPWDYFTSICRKLKIMRGSDAVGIAPRTIEQTGQNK

SEQ ID NO: 629 - DNA, 840 bp, Zea mays
gacatcaggaaccatcagttctttgtggcacgatggatgatttcatagtagaataacagggaatactggaaaaagcaagcatacacaggaagcagagagctccctgatttggcctttgaagggcacaagaacagatctgacggatcacatcacagacatacaaatacacacgtctcaagaacacgtggaaactacactaacatttgacgacttttgataattccgagcaactatttaagccttcaacatggccttccagctagctcagatttcttgcgtgggtgcaggcaaagaccaagcttatttgttctgacctgtctgctctatggttcttggagctattccaacagcatcagagcccctcatgattttgagcttccggcagatagaggtaaaataacgaattgtatatgaaacttatacggggtaatcagtttaccgaattatataacaaatgcgtttagtacctgcgccacaagtacattttttttcttttcatccttctgttatttgcatgtcaccatagtcccagggaagatcaccgacaagcatccagtctgcatccttatcctcatatgtaagtacatactcctggtctttgagggcatccaccttcgagccattagtcagcctgtctttgctcgatgatttatgcaggccactttgaccagcgatgaagcagctgaacatcttctggagcgccacggagaggtcctcgtagctggagtacatcttgatgtccaccttcctgaggtagggcgcgccatccatgctcaccttcacgtacatgggccgggccgcagacgcggcgtcctccgccgccggcgccttgctcctgga

SEQ ID NO: 630 - protein, 97 aa, Zea mays
MYVKVSMDGAPYLRKVDIKMYSSYEDLSVALQKMFSCFIAGQSGLHKSSSKDRLTNGSKVDALKDQEYVLTYEDKDADWMLVGDLPWDYGDMQITEG

SEQ ID NO: 631 - DNA, 255 bp, Zea mays
ctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggc

SEQ ID NO: 632 - protein, 120 aa, Zea mays
MYVKVSMDGAPYLRKVDIKMYSSYEDLSLALEKMFSCFIAGQSGLHKSSSKDRLTNGSKVDALKDQEYVLTYEDKDADWMLVGDLPWDYFTSICRKLKIMRGSDAVGIAPRTVEQTGQNK

SEQ ID NO: 633 - DNA, 255 bp, Zea mays
gatgaccacacattagcaagcttcattggacatttatatagagggacaacagacagtccatgggacactgtttttttgcaaactaggtagaggggtgctcaatcgtagtcgcagcactcattgtaccaaaccatttacacgtcgtacgaaggcttagcaacaatcaaatagcggggggttttttttttgtccgtagacgatgttgtaaaactaacattgacagacgtggagttctttacttgcgtagcagcaaaa

SEQ ID NO: 634 - protein, 244 aa, Zea mays
MSPPLDLDYIGLSPAAAAAAAHDDLKGTELRLGLPGSGSPDRRVVAATATTLDLLPAKGAKRGFSDEAPTPSPGAASGKGKKVAEEEDDKKVAATPQPVAKAQVVGWPPIRSYRKNTMSTTQLKGSKEDAEAKQDQGFLYVKVSMDGAPYLRKIDLKTYKNYKDLSTALEKMFSGFSTGKDGLSEYRKDGEYVLTYEDKDGDWMLVGDVPWEMFADSCRRLRIMKGSDAIGLAPRAADKSKNRN

SEQ ID NO: 635 - DNA, 580 bp, Zea mays
  misc_feature (7)..(34): n is a, c, g, or t
ttttttnnnnnnnnnnnnnnnnnnnnnnnnnnnntttttacagcaccttcgatcgctcatacaaaacacagttttgaaaacaaactgctagctaagattttatatacacgcttcatacatctttctcccttttgggttcagaaagaaacatgccttttttttttttggagagctcaagccacacagctcctccctcgctccttcctcgtcacgtaggatccgtgtgtgctcttggatccgcgttcccaggtggcgtgtctgtagcctctgtttatgtatggatcagcgatcacctggcctcagagcccttcattatcctgagcttcttgcaagaagagatgaacatatcccagggcacgtctccgacgagcatgaggtcgccgtccttgtcctcgtaggcgatggcgtgctggtggtcgccgccgccgtctgccgccgcggagaaggagttggcgaagagcgcgtccagagccttcctgagctccctgtaccccttgtacatccggaggtccaccttcctgaggtacggcgcgccgtccatgctcaccttcacgtacaggcctccctgctgctgcttctg

SEQ ID NO: 636 - protein, 83 aa, Zea mays
MDGAPYLRKVDLRMYKGYRELRKALDALFANSFSAAADGGGDHQHAIAYEDKDGDLMLVGDVPWDMFISSCKKLRIMKGSEAR

SEQ ID NO: 637 - DNA, 255 bp, Zea mays
aactcaaataaactaaagttatactaatggattcccccatcacctggcacatggcctgttccacccacttgaccacatacaggtaccataataataaataataatagtcccattgatgccctttacttaacaatcacataaacttgattaacaacactggaataaaatcaccaagtagattctgggagacacggtaggggacatgacataacaccaatccagctacacacggatatattattgcttctggtccat

SEQ ID NO: 638 - protein, 227 aa, Zea mays
MAGADVDVGTELRLGLPGGGAAAAKKDTIDLKLKLPTAGMEEAAAAARPEPAAEKAKRPAEAPAADAEKPPAPKAQAVGWPPVRSYRRNAMTVVQAVRSKKEEEPEKQQQPAAANAFVKVSMDGAPYLRKVDLKTYGSYKDLSAALKKMFGTFTASGNSMNEGRLVDPAGDADDVVTTYEDKDGDWMLVGDVPWEMFVDSCKRLRIMKSSEAIGLAPRTKDKCKNKS

SEQ ID NO: 639 - DNA, 671 bp, Zea mays
ccaccggacagcatggacattttctttacccccttccaggaaatgaagcgctacaaacttccaaacacagatgaaagtatcaaacagcaagcagtacgctatctttcccaaaaaaaaagcgacagcacgggacgaccagctcgggggcaaaaggggcgtccaaaacagcaggacgcaaatcccactgcacaagtgaaaaaaggcctgaccaaggcagcgtccctctcccttcagttcagcgccaggaaagaaagctgccccccctcatttgttccaaactgtctgttccgggggtcttggaggagccatgccagcagcatcaaagcctctcatgatcctaagtttccggcaaaagggggggaacaagtcccagggcaaatcaccaacgagcatccagtcagcatctttatcttcgaaagaaaggacatattcttggtcctgaagggcatcaaccctaaaaccatcagtaagcctatcccttcttgaagtcttgcatgaactgttttgaccagggatgaagcaactgaacattttctccaaaccaagcgaaaaatcctcatagcttgaataggtcttgaggtccaccttccttaggtatggggctccatccatgctgaccttgacataaaagcatcccgcctcactcctaccttcatctcccccatttgtct

SEQ ID NO: 640 - protein, 115 aa, Zea mays
MDGAPYLRKVDLKTYSSYEDFSLGLEKMFSCFIPGQNSSCKTSRRDRLTDGFRVDALQDQEYVLSFEDKDADWMLVGDLPWDLFPPFCRKLRIMRGFDAAGMAPPRPPEQTVWNK

SEQ ID NO: 641 - DNA, 255 bp, Zea mays
ctccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctccc

SEQ ID NO: 642 - protein, 212 aa, Zea mays
MSPPLDLDYIGLSPAAAAAAAHDDLKGTELRLGLPGSGSPDRRVVAATATTLDLLPAKGAKRGFSDEAPTPSPGAASGKGKKVAEEEDDKKVAATPQPVAKAQVVGWPPIRSYRKNTMSTTQLKGSKEDAEAKQDQGFLYVKVSMDGAPYLRKIDLKTYKNYKDLSTALEKMFSGFSTGEMSRVTLLSRMARQYVIVFHFDVDGVRSTSRSL

SEQ ID NO: 643 - DNA, 872 bp, Zea mays
  misc_feature (15)..(15): n is a, c, g, or t
  misc_feature (783)..(783): n is a, c, g, or t
agcagtttggtccgnattcccggccgaccccgcgtccgccgtccttcggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaagggcgccaagcgcgggttttctgacgaggcgccgacgccatcgcccggtgcagcttccgggaagggaaagaaggtagcggaagaggaggacgacaagaaggttgcagcgacgccgcagccggtcgcaaaagctcaggtggtgggatggccaccaatccgaagctaccgcaagaacacgatgtctaccacccagctgaagggcagcaaggaggatgctgaggccaagcaggaccaggggttcctgtacgtcaaggtcagcatggatggcgcgccgtacctcaggaagattgacctcaagacttacaagaactacaaggacctgtcgactgcgcttgagaagatgttcagtggcttcagtactggcaaggatggcttatctgagtaccgcaaggatggtgaatatgttctgacttacgaggacaaggatggagattggatgcttgttggcgatgtaccatgggagatgttcgctgactcttgccgccagctcaggatcatgaaaagatcagatgcaattggacttgctccaaggcagctgatnagtccaagaatcgcaactagaatggttgcttcttacgtccagagcagagggagaatccagtgactgtaggggatcttgtggaagcggaa

SEQ ID NO: 644 - protein, 258 aa, Zea mays
  misc_feature (238)..(238): Xaa can be any naturally occurring amino acid
MSPPLDLDYIGLSPAAAAAAAHDDLKGTELRLGLPGSGSPDRRVVAATATTLDLLPAKGAKRGFSDEAPTPSPGAASGKGKKVAEEEDDKKVAATPQPVAKAQVVGWPPIRSYRKNTMSTTQLKGSKEDAEAKQDQGFLYVKVSMDGAPYLRKIDLKTYKNYKDLSTALEKMFSGFSTGKDGLSEYRKDGEYVLTYEDKDGDWMLVGDVPWEMFADSCRQLRIMKRSDAIGLAPRQLXSPRIATRMVASYVQSRGRIQ

SEQ ID NO: 645 - DNA, 687 bp, Zea mays
ccacacattaacaagcttcattggacatttatataaagggacaacaaacagtccatgggacactgtttttttgcaaactaaggaaaggggggctcaatcctaatcccaacactcattgtaccaaaccatttacacgtcgtacgaaggcttaacaacaatcaaaaagcggggggttttttttttgtccgaaaacgaagttgtaaaactaacattgacaaacgtggagttctttacttgcgtaacaacaaaaacatgtggaacaaaccaaaaggcaaaattcttcttgaaactgttaaacgttttccggcttccacaaaaatccctacagtcactggatatctccctcttgctctggactggaaaaaacaaccattctagttgcgattcttggacttatcacctgcccttggagcaagtccaattgcatctgatcctttcatgatcctgagcctgcggaaaaaatcagcgaacatctcccatggtacatcgccaacaaacatccaatctccatccttgtcctcgaaagtcaaaaaatattcaccatccttgcggtactcaaaaaaaccatccttgccagtactgaagccactgaacatcttctcaagcgcagtcgaaaggtccttgtagttcttgtaagtcttgaggtcaatcttcctgaggtacggcgcgccatccatgctgaccttg

SEQ ID NO: 646 - protein, 100 aa, Zea mays
MDGAPYLRKIDLKTYKNYKDLSTALEKMFSGFSTGKDGFFEYRKDGEYFLTFEDKDGDWMFVGDVPWEMFADFFRRLRIMKGSDAIGLAPRAGDKSKNRN

SEQ ID NO: 647 - DNA, 255 bp, Zea mays
ttgtacaaaaaagcaggctggtaccggtccggaattcccgggatccaccacctcctactccgctgcaaccccaaatctctccttcctcgcatacgcgcgcagcagaggagctgagaccaacgaagaagaagaacaaccgagcaagcacaagcttagctagcgtggaggtgcccaaggcgacgacggccgccgcgccaggctagccaaccagctgctcatcgctcctagctgcggagccgatggctggagccgacg

SEQ ID NO: 648 - protein, 237 aa, Zea mays
MAGADVDVGTELRLGLPGGGADAAKAAKRGFEDTIDLKLKLPTAGMEEAAAAAAAKPEPAAEKAKRPAEAPAADAEKPPAPKAQAVGWPPVRSYRRNVMTVQSVKSKKEEEPEKQQSAANAGGNGSAFVKVSMDGAPYLRKVDLKMYNSYTELSVALKKMFSTFTTSGNNMNEGKLVDPVSGADVVTTYEDKDGDWMLVGDVPWEMFVESCRRLRIMKSSEAIGLAPRTKDKCKNRS

SEQ ID NO: 649 - DNA, 720 bp, Zea mays
ccaatccacctacacacaaataaattattgcttctggtccatgaacaaattgaacaaaacaggtctccctccaactaataattaaaacgcattatatttctaaaaaaaccgcagcacactgcaagggcaccatttttttgacacaacgggcagcgtctttaacgctgtatcttcttcagctcctgttcttgcacttgtccttcgttcttggggcaaaacctatggcttcaaaactcttcatgatcctcaaacgcctgcatgactcgacaaacatctcccacgggacgtccccaacgaacatccagtccccatccttgtcttcgtaagtaatgaccacatcagcaccgctgaccggatcaactatttttccctcattcatgttgttcccggatgtggggaaggtgctgaacatcttcttcaaaacaacggaaagctccgtgtagctgttgtacatcttcaggtccaccttgcgcaggtagggcgcgccgtccatgctgaccttcacaaaggcggaaccgttgcccccggcgttggcagcggactgctgcttctcaggctcctcttccttcttgctcttcacagactggacggtcatgacgttcctgcggtatgaccggactggtggccaacccacagcttgtgccttgggtgcgggtggcttctcggcatcagcggccggcgcctcggcgggcctcttggccttctcgggggccggctccg

SEQ ID NO: 650 - protein, 139 aa, Zea mays
MTVQSVKSKKEEEPEKQQSAANAGGNGSAFVKVSMDGAPYLRKVDLKMYNSYTELSVVLKKMFSTFPTSGNNMNEGKIVDPVSGADVVITYEDKDGDWMFVGDVPWEMFVESCRRLRIMKSFEAIGFAPRTKDKCKNRS

SEQ ID NO: 651 - DNA, 753 bp, Zea mays
cagtttgcaacttccgcaagaacacgaggactaccacccagctggagggcagcaaggaggatggtgatgccaagcagggtcaggggttcctgtacgtcaaggtcagcatggatggcgcgccgtacctcaggaagatcgacctcaagacttacaagaactacaaggacctgtcgaccgcgcttgagaagatgttcagtggcttcagtactggcaaggacggctcatctgagtaccgcaaggatggtgaatatgttctgacttacgaggacaaggatggagattggatgcttgtcggcgacgtaccatgggactgccacatcgtctttcgctccaattgtaggatgttcgccggctcctgccgcaggctcaggatcatgaaaggctcagatgcgattggactcgctccaagggcagccgataagtccaagaaccgcaactagaacggtggcttcctatccttacacagtccggtacgagggaggagatgcagtgacttgtaaggatctgtacgaaaaccgaaaaagtctactaacagctatgacttgtgagaagaattctggcttatggtctgcactagaatggcttggtacatcgtctatggacaaaacacgctattcgattaattgttgttaattaagccttggggggggtacgagtgctattcatgtaaatggtttggtgcatcgtgtgctgctgctgcctgctgctgttactacgattgagctcccctataatactatgatttgaagagag

SEQ ID NO: 652 - protein, 110 aa, Zea mays
MDGAPYLRKIDLKTYKNYKDLSTALEKMFSGFSTGKDGSSEYRKDGEYVLTYEDKDGDWMLVGDVPWDCHIVFRSNCRMFAGSCRRLRIMKGSDAIGLAPRAADKSKNRN

SEQ ID NO: 653 - DNA, 255 bp, Zea mays
catatgacatccccctctctcttcaaatcatagtattataggggagctcaatcgtagtaacagcagcaggcagcagcagcacacgatgcaccaaaccatttacatgaatagcactcgtaccccccccaaggcttaattaacaacaattaatcgaatagcgtgttttgtccatagacgatgtaccaagccattctagtgcagaccataagccagaattcttctcacaagtcatagctgttagtagactttttcggt

SEQ ID NO: 654 - protein, 246 aa, Zea mays
MSPPLELDYIGLSPPAAAAAAENDELKGTELRLGLPGSGSPDRRVVAATATTLDLLPAKGAKRGFSDEAPPPSPVATAGKGKKVAEEEYDEKKVAATPQPAAKAQVVGWPPVCNYRKNTMTTTQLEGSKEDGDAKQGQGFLYVKVSMDGAPYLRKIDLKTYKNYKDLSTALEKMFSGFSTGKDGSSEYRKDGEYVLTYEDKDGDWMLVGDVPWEMFAGSCRRLRIMKGSDAIGLAPRAADKSKNRN

SEQ ID NO: 655 - DNA, 567 bp, Zea mays
cttcaaatcatagtattataggggagctcaatcgtagtagcaggcagcagcagtacacgatgcaccaaaccatttacatgaatagcactcgtaccccccaaggcttaaaacaacaattaatcgaatagcgtgttttgtccatagacgatgtaccaagccattctagtgcagaccataagccagaattcttctcacaagtcatagctgttagtagactttttcggttttcgtacagatccctacaagtcactgcatctcctccctcttgcgtgctccggactgaccgttctagttgcggttcttggatttatcggctgcccttggagcgagtccaatcgcatctgagcctttcatgatcctgagcctgcggcaggagcgggcgaacatctcccatggtacgtcgccgacaagcatccaatctccatccttgtcctcgtaagtcagaacatattcaccatccttgcggtactcagatgagccgtccttgccagtactgaagccactgaacatcttctcaagcgcggtcgacaggtccttgtagttcttgtaagtcttgaccaacacaat

SEQ ID NO: 656 - protein, 73 aa, Zea mays
MFSGFSTGKDGSSEYRKDGEYVLTYEDKDGDWMLVGDVPWEMFARSCRRLRIMKGSDAIGLAPRAADKSKNRN

SEQ ID NO: 657 - DNA, 619 bp, Zea mays
atgcaccaaaccatttacatgaatagcactcgtacccccccaaggcttaattaacaacaattaatcgaatagcgtgttttgtccatagacgatgtaccaagccattctagtgcagaccaataccataagccagaattcctctcacaagtcatagctgttagtagactttttcggttttcgtacagatccctacaagtcactgcatctcctccctcgtaccggactgtgtaaggataggaagccaccgttctagttgcggttcttggacttatcggctgcccttggagcgagtccaatcgcatctgagcctttcatgatcctgagcctgcggcaggagccggcgaacatctcccatggtacgtcgccgacaagcatccaatctccatccttgtcctcgtaagtcagaacatattcaccatccttgcggtactcagatgagccgtccttgccagtactgaagccattgaacatcttctcaagcgcggtcgacaggtccttgtagttcttgtaagtcttgaggtcgatcttcctgaggtacggcgcgccatccatgctgaccttgacgtacaggaacccctgaccctgcttggcatcaccatcctccttgctgcccccgcgt

SEQ ID NO: 658 - protein, 100 aa, Zea mays
MDGAPYLRKIDLKTYKNYKDLSTALEKMFNGFSTGKDGSSEYRKDGEYVLTYEDKDGDWMLVGDVPWEMFAGSCRRLRIMKGSDAIGLAPRAADKSKNRN

SEQ ID NO: 659 - DNA, 255 bp, Zea mays
ctggaacacatattgcgccagagcatctgataccaagacaggattaaaatgcaggagaggaaatagcagctacggaggatgctaaatgtcgcaagcaacatgaccgacgatatacatatgccactaccaaaacagctgtgtacataagccctagtatatattactagagaggtgagagggggcggcccgcgccgacggccaggtgagacggcagcagtcagtgtaacagtctacagaaccgaagtagccggcaac

SEQ ID NO: 660 - protein, 230 aa, Zea mays
MRETRTESYSASINKAPTEKKQESTTSGCRLFGIEIGSSAVSPVVTVASVGHDPPPPALSVDAESDQLSQPSHANKATDAPAASSDRSPNETESRQARSCTKVIMQGVAVGRAVDLTRLDGYDDLRRKLEEMFDIPGELSASLKKWKVIYTDDEDDMMLVGDDPWSEFCRMVKRIYIYSYEEAKSLTPKAKLPAIGGDTGVKPDPSKLPPESDVPQSDSDNSAPVAADKD

SEQ ID NO: 661 - DNA, 255 bp, Zea mays
tagaacaagtttagtacaaaaaagcaggctggtaccggtccggaattcccgggatgctcatcacatccatctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgtggacgactgcagccagcaccagcagcagacccagctga

SEQ ID NO: 662 - protein, 258 aa, Zea mays
MLITSISFYYCLRDQAAATGEGDLFYKVKYLAWDMETVVGDLMATELRLGLPGTVDDCSQHQQQTQLKVAAPPSNPTRGKKRPAAEEEEANKRDAEAAPPAAKAPVVGWPPVRSYRKSCFQQAKQQAVSSSSKAADKEDAAAPAPSCTASAAASNATASAGAGSFVKVSMDGAPYLRKLDLRMYKGYRELREALEAMFVSSGSANNNNNLSEFAVTYQDKDGDLMLVGDVPFEMFASTCRKLRIMKRSEATGLGSARQ

SEQ ID NO: 663 - DNA, 255 bp, Zea mays
ccccatccaacacccgggtgggtggttggcgttgcattgcagaccacagcaattagcaaagacatactgtgcggcaacatggaattcagatatgaacacagatatgaaacagcagagcagatacttctgccatatcaaacacaaggataaaaaccaacactttgggcgaccattcctcacaggtaaacagcgtggacagaagagctgggggcgatgatgctcgtatagcccataagaaaagctcaacgagggcac

SEQ ID NO: 664 - protein, 158 aa, Zea mays
MNSLFNQAKENASEAGAKKPIVEPDMQEDKEESKKGRTVGWVKVNMEGDIIGRKVDLNAHRSYKTLASALELMFMKPSIGLCTSSSSKTLKLLDSSSEYQLTYEDRDGDWMLVGDVPWEMFVGSVKRLKIMRTSDAKGLGPRFQGSHRPTAACTRGRT

SEQ ID NO: 665 - DNA, 255 bp, Zea mays
aaagctagggtaacgcgtaagcttagggcccctcgagggatactctagagcggccgccctttttttttttttttttttttttttttttttttgaaaacaacaaggaagagaggtgatcatattacaatacaacttttttttaacaccttgcaacagttatttgttccactgacacaccatggtaattataatcaaacagcttatgatgcaaaaggccctttgatcaggagcagggtgcctttgcatcttgtgcca

SEQ ID NO: 666 - protein, 273 aa, Zea mays
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAVLADPAEKPRAAKAQVVGWPPVRSFRKNIMSVQSDKGAGKDAAAANGDKSSAAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 667 - DNA, 56 bp, Artificial sequence
  primer: prm09131
ggggacaagtttgtacaaaaaagcaggcttaaacaatggaagaagaaaagagattg

SEQ ID NO: 668 - DNA, 49 bp, Artificial sequence
  primer: prm09132
ggggaccactttgtacaagaaagctgggtaacctctctctattccttgc

SEQ ID NO: 669 - DNA, 2194 bp, Oryza sativa; identical to SEQ ID NO: 218

SEQ ID NO: 670 - protein, 6 aa, Artificial sequence
  IAA2 motif
  VARIANT (1)..(1): / replace = "Asn"
  VARIANT (2)..(2): / replace = "Met"
  VARIANT (4)..(4): / replace = "Trp"
  VARIANT (5)..(5): / replace = "Gly"
KIFSQL

SEQ ID NO: 671 - DNA, 851 bp, Populus trichocarpa
agcaacaacaacaacaaaaataacaatacttctctcaacatgaaagaaactgagctaaggcttggcttgccagggtctcatctccagagagaaaaccaacagtacccgcagctggggtgtctcttgttggaaaagatattgacaccaacaacactaatgctattctcttatcccagtaaagaatttagtgtcaggggctaagagagttttctcagatgccattgatgggtctactgggaatgggttttctctggtggcgataatggtaacccgcagaaatctcgggtagcaggacctgcgaagaaagatgttgctcaatcccaaagccagttcaagagaaaaacagccaagtggctgctgcaaatgagaacagcagtgctcctgctgcaaagacacaggtgtaggatggccaccaattcgctctttccggaagaacaccatggcctctagtttggcgaagaacaatgaagatgtcgacggaaatcaggatatggttacctgtatgtaaaggttagcatggatggtgctccataccttaggaaggttgaccttaaaacttaggcaattatctggagctctcatctgctcttgagaaaatgtttggctgcttcaccattggacaatgtggttctcatgggctgcagcgcgagatggcctaactgagagttgtttgaaggatctacatggttctgaatatgttctcacatttgaagacaaggaggtgattggatgctggttggtgatgttccttgggacatgtttaccgactcatgcaggagattgaggatcatgaaaggttcgaagcaattggacttgccccaagggccatggagaaatgcaagaaccgtaat

SEQ ID NO: 672 - protein, 284 aa, Populus trichocarpa
SNNNNKNNNTSLNMKETELRLGLPGSQSPERKPTVPAAGVSLVGKDIDTNNTNAYSLIPVKNLVSGAKRVFSDAIDGSTGWVFSGGDNGNPQKSRVAGPAKKDVAQSPKPVQEKNSQVAAANENSSAPAAKTQVVGWPPIRSFRKNTMASSLAKNNEDVDKSGYGYLYVKVSMDGAPYLRKVDLKTYGNYLELSSALEKMFGCFTIGQCGSHGLAARDGLTESCLKDLHGSEYVLTFEDKGDWMLVGDVPWDMFTDSCRRLRIMKGSEAIGLAPRAMEKCKNRN

SEQ ID NO: 673 - DNA, 466 bp, Populus trichocarpa
aaaaatgaaaagaaaagggttttctcagagttgtccggcgaagcaaacagcacaaccgatgggcgaaaaacccaaacaacagtcaagttgtggggtggccaccagtatgttcctatcgaaagaagaatagtttcaatgagaaagatagccatgaaacttcaaaatttacgtgaaagttagtatggacggagctccttttctcagaaaagttgatttgggcatgcacaaggagtattcggacttgttgtcgcgttggagaagttgtttggctgttttggaatcggcaaagccttgaaggatacagacgactgcgaatacgtcccatatatgaagacaaggatggagactggatgctagtgggagacgtgccttgggagatgtttattgagtcttgcaagagctaaggataatgaagaggtcagaagccaagggttttggactgcagccaagaggtgctcttcagcag

SEQ ID NO: 674 - protein, 156 aa, Populus trichocarpa
KNEKKRVFSELSGEANSTTDGRKTQTTSQVVGWPPVCSYRKKNSFNEKDSHETSKIYVKVSMDGAPFLRKVDLGMHKEYSLVVALEKLFGCFGIGKALKDTDDCEYVPIYEDKDGDWMLVGDVPWEMFIESCKRLRIMKRSEAKGFGLQPRGALQQ

SEQ ID NO: 675 - DNA, 466 bp, Populus trichocarpa; identical to SEQ ID NO: 673

SEQ ID NO: 676 - protein, 156 aa, Populus trichocarpa; identical to SEQ ID NO: 674

SEQ ID NO: 677 - DNA, 673 bp, Populus trichocarpa
atgcggtttgaggagacagagctaaggctagggttaccagggaatggtggagggggtactgaaggaggggagttcgcaagaagagaggattctctgagactgtggacttgaagctcaatctttcttccaaggaggggggtattgatccaaatcatgagaaactcaaagggagaagaaccttctggccactgatccagcaaaacctccagctaaggcacaggttgtgggttggcctccagtagatctttccgaaagaacatgttagctgtccaaaaaagcagcaccgatcaggagagtactgacaaggttcctgggggcaagcaacctttgtgaaggttagcatggatggcgcaccttacctccgtaaagtggacctgaagatgtacaagacctaccacgactctctgatgccttgggcaaaatgttcagttccttcaccataggcaactgtggatcccatggaatgaaagatttcctgaagaaagcaagctcatagatcttcttaatggcaccgactatgttccaacttatgaagataaggacggtgactggatgctcgtggagatgtcccatgggacatgtttgttgaatcatgcaagcggctgcgaataatgaaaggaacggaggcgactggacttgcccaagagccatggagaaatgcaagaacagaagc

SEQ ID NO: 678 - protein, 225 aa, Populus trichocarpa
MRFEETELRLGLPGNGGGGTEGGEFARKRGFSETVDLKLNLSSKEGGIDPNHEKTQREKNLLATDPAKPPAKAQVVGWPPRSFRKNMLAVQKSSTDQESTDKVPGGNATFVKVSMDGAPYLRKVDLKMYKTYHELSDALGKMFSSFTIGNCGSHGMKDFLESKLIDLLNGTDYVPTYEDKDGDWMLVGDVPWDMFVESCKRLRIMKGTEATGLAPRAMEKCKNRS

SEQ ID NO: 679 - DNA, 560 bp, Populus trichocarpa
atggattctaatgcatcaggcttccttctaaaccctccagctcttcactctacttactatcagcctagggaagatgatggattattgatctgggtctcagtctcagaactttgaagcctgaggcttatcatccatctggacatctggtaggcctggagggtatggtgacctgatggactggcctcgggcaaactcaccactaaaacactccacttcaagctacattagatttaccccacagattgtgacgaggaggcagagggagttcagagcaaagacaggtgggcttatgtgaaggtaaacatggatggggtgattgtggtaggaaaatatgcatgctagatcatggtggttactcaagcctcgcacttcagctcgaagacatgtttggtagacaatcgcatctgggttaaggctgttccaagcaggttctgaattctgcctgttctataaggacagagaggagaattggagaaccgtggtgatgttccttggaaggagtttgtagaaagcgtcaagcggctgaggattgcacgaaaaagcgaacctcttcttccata

SEQ ID NO: 680 - protein, 187 aa, Populus trichocarpa
MDSNASGFLLNPPALHSTYYQPREDDGIIDLGLSLRTLKPEAYHPSGHLVGLEGYGDLMDWPRANSPLKHSTSSYIRFTPDCDEEAEGVQSKDRWAYVKVNMDGVIVGRKICMLDHGGYSSLALQLEDMFGRQSASGLRLFQAGSEFCLFYKDREENWRTGDVPWKEFVESVKRLRIARKSEPLLPY

SEQ ID NO: 681 - DNA, 786 bp, Populus trichocarpa
gaagctgagctagagttgggtctggggctgagtcttggtagtggtggaggaggaaagggtaaggcaaatgcatggggtgatgtggtagaatcttgactgccaaggactttccttcggtggtctctcagcctcaaaggcccaacaacaacaactctatgcctctacctgtgttgttggtgctgtttctgggactaagagagctgctgactctgtctcccatgagggtggatcccctactgcggcagcagtcaggttgtggggtggcctcctataagggcttatcggatgaatagcttggtgagccaagcaaaggctgcgaggctgaagaagaaaagggaattggtgagaaggataaatctaaggagaatttgaagaagaaaatctgtaatggtaacaagacaatgctactggtaatgaaaaggggcatcttggatttgtcaaggtgaatatggatggagttccaattggaaggaaggtagattgaatgcccatgcttgttatgaaacattagcccaggcattagaggaaatgttcttcaggtccaccaccactatcaattcatcggtgagacgaagccactatcaaagttctctaagctattggatgggtcgtctgagtttgtgctcacttatgaagataagagggagactggatgctcgtgggagatgttccttgggggatgttcctcacctctgtaaaaaggcttcgaatcatgaggactcagaggccaatggacttgctccaagactccaggataggaatgagaaacaaagaagcaagcctgtt

SEQ ID NO: 682 - protein, 262 aa, Populus trichocarpa
EAELELGLGLSLGSGGGGKGKANAWGECGRILTAKDFPSVVSQPQRPNNNNSMPSTCVVGAVSGTKRAADSVSHEGGSPTGSSQVVGWPPIRAYRMNSLVSQAKAARAEEEKGIGEKDKSKENLKKKICNGNKTNATGNEKGHLGFVKVNMDGVPIGRKVLNAHACYETLAQALEEMFFRSTTTINSIGETKPLSKFSKLLDGSSEFVLTYEDKEGDWMLVGDVPWGMFLTSVKRLRIMRSEANGLAPRLQDRNEKQRSKPV

SEQ ID NO: 683 - DNA, 460 bp, Populus trichocarpa
agggcacaagttgtgggttggccacccattagatcattccgtaagaatgtcatggctgtacagaagaacagcaatgacaaggtgaaaaatccggtagcagtggcaccggtgtggcttttgttaaggttagcatggatggtgctccgtatttacgaaaagtgacttgaaattatacaagagctaccaagaactctctgacgctctaggcaaaatgttcagctccttcaccattggtaactgggctcacaaggaatgaaagatttcatgaatgaaagcaaattgatagatcttttgaatggttccgattatgtgccaacttagaagacaaggatggagattggatgcttgtaggagatgttccatgggaaatgtttgtggattcatgcaagcgcttgaggatatgaaagggtctgaggctattggacttgccccgagagccgtagagaagtgcaagaacaga

SEQ ID NO: 684 - protein, 154 aa, Populus trichocarpa
RAQVVGWPPIRSFRKNVMAVQKNSNDNGEKSGSSGTGVAFVKVSMDGAPYLRKVDLKLYKSYQELSDALGKMFSSFTIGNGSQGMKDFMNESKLIDLLNGSDYVPTYEDKDGDWMLVGDVPWEMFVDSCKRLRIMKGSEAIGLAPRAVEKCKNR

SEQ ID NO: 685 - DNA, 475 bp, Populus trichocarpa
agagctgcacttgcaccagtagtcgggtggcctccaatccggtcgtttaggaaaaaccttgcaggtagcagtactccaaactggtatctgagtcacgaaataaacctccaaaagaagggagtagcttaaaacctgacagtttcagaaatgacttgtttgtaagatcaatatggaaggagtccctattggaagaaaaataaacctcaatgcctatgacagttacgagaaactctctgttgcatagatgaactcttcagaggtcttcttgcagctcgaagagaaactgctgatcctaggaatgacaaaaaggtgaaagaagcaacgcaaatgcaggttcagtttctggaagtggggaatatactctcgtttatgaggacaatgaaggagacaggattcttgtggggatgttccatggcatatgtttgtatctacagcaaagagattgcgcgtactgaagagcactgagatttccact

SEQ ID NO: 686 - protein, 159 aa, Populus trichocarpa
RAALAPVVGWPPIRSFRKNLAGSSTPKLVSESRNKPPKEGSSLKPDSFRNDLFVKINMEGVPIGRKINLNAYDSYEKLSVIDELFRGLLAARRETADPRNDKKVKEANANAGSVSGSGEYTLVYEDNEGDRILVGDVPWHMFVSTAKRLRVLKSTEIST

SEQ ID NO: 687 - DNA, 655 bp, Populus trichocarpa
attaattatgaagagactgaattacgcctagggttacctggaggtgctagtaatggaaatgatggtgaggctgcaaagggaatgggaagagagggttttcagagacggttgacttgaagcttaacctttcaactaaagaaactggaaaggatggatcagacaggagaaagtagtaatgaaggagaaaactgttgctcctcgccccaatgatcctgcaaagccaccgtccaaggcacaagtgtgggttggccacccattagatcattccgtaaaaatgccagtagcagtggcactactggtactgcagctttcgttaaggtagcatggatggtgccccatacttgcgaaaagtggacttgaaattatacaagagctaccgagaactctctgatgctctaggaaaatgttcagctccttcaccatcggtaactgtggctcacaaggaacgaaagatttcatgaatgaaagcaaattgatagacttttgaatagttctgagtatgtgccaacttatgaagacaaggatggagattggatgcttgtaggagatgttccatggggatgtttgtcgattcatgcaagcgcttgaggatcatgaaagggtctgaggccattggacttgccccaagagctgtggagaatgcaagaacagaagt

SEQ ID NO: 688 - protein, 219 aa, Populus trichocarpa
INYEETELRLGLPGGASNGNDGEAAKGNGKRGFSETVDLKLNLSTKETGKDGSDQEKVVMKEKTVAPRPNDPAKPPSKAQVGWPPIRSFRKNASSSGTTGTAAFVKVSMDGAPYLRKVDLKLYKSYRELSDALGKMFSSFTIGNCGSQGTKDFMNESKLILLNSSEYVPTYEDKDGDWMLVGDVPWGMFVDSCKRLRIMKGSEAIGLAPRAVEKCKNRS

SEQ ID NO: 689 - DNA, 480 bp, Populus trichocarpa
gcaacagtagttgggtggcctccaatccggtcattcaggaaaaatattgcaagtagcagtacttcaaagatggtatctgattaccaaataaaacttcagaagaagggagcagcttaaagcctgacagtttcaggaatgatttgtttgtaaagatcaatatgaaggagtccctattggaagaaaaataaacctcaatgcctatgacagttatgagaaactctctgttgccatagatgagctttcagaggttttcttgcagctcaaagggaaacttgtgatcctatgggtgaaaacaagatggatgaagcaaaggaaaattgtcagtttctggtagcagggaatatactctcgtttatgaggacaatgaaggtgacaggattcttgttggagatgttccttgcatatgtttgtatctacagcgaagagactgcgcgtactgaagagcactgagaaaggtgcgtttactttaaagtcatcgag

SEQ ID NO: 690 - protein, 160 aa, Populus trichocarpa
ATVVGWPPIRSFRKNIASSSTSKMVSELPNKTSEEGSSLKPDSFRNDLFVKINMEGVPIGRKINLNAYDSYEKLSVAIDEFRGFLAAQRETCDPMGENKMDEAKENCSVSGSREYTLVYEDNEGDRILVGDVPWHMFVSTAKRLRVLKSTEKGAFTLKSS

SEQ ID NO: 691 - DNA, 892 bp, Populus trichocarpa
atggagcttcaactaggtctttcccttccaacctacaattttattgaaaactttgacctgaacaatggtgggtttgagccaaagatcagatgcttggttcgaaaccatggatcagctgcgaagatggtaattacttggacaacaaacgtagctttgaagtgcctttgaaaagaatatcaaagatgcatctcaagaattgcctttacttttatggagtggccaaccaaatgatgaagatgatggaatggagagaagaaaatctctcgtagcattaacaaggatgatgaagaggaaaatcaagttgtggggtggccacctataagtcatggaggaagaaggtgcttcatcaccagcatcaagctggtcatgttgtgaatagtactagaatggcaacagctggaattatgaatatggtactggatcaaactccaagtatgtcaaggtgaagatggaaggagtagcaataacaagaaagattgattaaggctctacaactcttaccagacactcacaaaatccttgatcagcatgtttgcaaaatgcaaaaaccttgaaaaagagctgcacgttacagtctgacataccaagacaaagatggggactggctaattgcaggagatgttccatggcagactttcatgagtctgtgcagcgtttgaagatagtaaggaatgctggttaaattggtttggattgatgatcaattattgtgtccctgtgtacagtgtactataagagatcgcatgtatttataccctagtgttagaggaagagcataattaattagattattaagccttaattaaatgttgtattggatgtaattgaagtaatttagcattgtaagtttgtaatcttaatttgttgttaattccatcattaagttgtcttg

SEQ ID NO: 692 - protein, 227 aa, Populus trichocarpa
MELQLGLSLPTYNFIENFDLNNGGFEPKDQMLGSKPWISCEDGNYLDNKRSFEVAFEKNIKDASQELPLLLWSGQPNDEDWNGEKKISRSINKDDEEENQVVGWPPIKSWRKKVLHHQHQAGHVVNSTRMATAGNYEYGTGSNSKYVKVKMEGVAITRKILRLYNSYQTLTKSLISMFAKCKNLEKDAARYSLTYQDKDGDWLIAGDVPWQTFMESVQRLKIVRNAG

SEQ ID NO: 693 - DNA, 255 bp, Populus trichocarpa
ccctcgcagagagaatactagctattatttatttctctcaagaatctacatatcaaaaggaaacaacaagagcaatcttcagtctcctgtgtacatcatctctttacagatcctgcgcgtgaacaaagattgttggaaaacatggaaggtggtgttgcattgagaatgatctaaacctcaaggaaactgagcttagactgggtttgccagggacgggttgtaccaatgagaaaggagttttggtgctagaaacaa

SEQ ID NO: 694 - protein, 205 aa, Populus trichocarpa
MEGGVAYENDLNLKETELRLGLPGTGCTNEKGVSGARNNKRPFPETREEGGANGKSDAQHDDQETASAPNTYSFDMHATCVQIVGWPPIRSYRKNSLQPKKAEDEAAAGMYVKVSMDGAPYLRKIDLKVYKGYPELLKALENMFKLTIGEYSEREGYKGSYAPTYEDKDGDWMLVGDVPWDMFLSSCKKLRIMKGSEAIGLGCGA

SEQ ID NO: 695 - DNA, 255 bp, Populus trichocarpa
gaagcccaacttatattattgaggtctctctctctctctctctctctcagctagcttgcaaaacatagaagaggacacaaaaataagaaacaaagaaacgagcaaaagctagctatcagcaacaccaaaagcaacaagcaataatacaaaacatatcagacttccactaaaaccattcattggcgcgcgcgtggcagagagaaatggcaacagctaccgtgttaggtaccgagatggcagtttgaactacaaaga

SEQ ID NO: 696 - protein, 274 aa, Populus trichocarpa
MATATVLGTEMADLNYKETELCLGLPGAVGVKNEVETPNKATGKRGFAETVDLKLNLQAKEGVMDLNENIKNIASKDKNHPADTIKDPAKPPAKAQVVGWPPVRSYRKNVLAQKNASEEGFRAQVVGWPPLRSYRKNVLTQKNASEEGDKASTGGSSAAFKVCMDGAPYLRKVDLKMYKSYQELSDALAKMFSSFTMGNYGAQGMIDFMNESKLMDLLNSSEYVPSYEDKDGDWMLVGDVWEMFVDSCKRLRIMKGSEAIGLAPRAMEKCKSRT

SEQ ID NO: 697 - DNA, 694 bp, Populus trichocarpa
atggaacttcaacttggtctcggtctcccaagtgagaaaacaatgaagggtttagacctaaacagctatgtttctgagccaaagggttgctgggctcgggacaacttcaactgggtcaatattcatggttttctacgaatgctaatgacaagaaacggagtttattgatgcctttgaagagagctcaggaaatgaagatgggcctcaaacgttacctctcttggtttggaataaccagccaacgacgaagatgatttccctaaagatctcgacaaccatagtagcaactcttgtgcctccaacaaaagtgatggagaaaggattggatagtggggtggccaccaataaagttcaagaagaagaagcttagtcgtcaaagcagcagggcgctagagatcaacgggcagtggacaatggttatgaagattgccaagctagaacatcaaagtatatgtacattaaggtcaagatggagggggtggaatagcaaggaaaattgatgttagcctccaccattcttttccaacactcaagcagaccttgcttgacatgtttgggattgccaggaaaattcaagcaactacagactgacttaccaggatagagaaggtgactggctactagctgaagatgtaccttgaggaactttcttgggacagtccaactactaaaattgatgaggagaagcagctga

SEQ ID NO: 698 - protein, 231 aa, Populus trichocarpa
MELQLGLGLPSEKTMKGLDLNSYVSEPKGLLGSGQLQLGQYSWFSTNANDKKRSFIDAFEESSGNEDGPQTLPLLVWNNQNDEDDFPKDLDNHSSNSCASNKSDGESDWIVGWPPIKFKKKKLSRQSSRALEINRAVDNGYEDCQARTSKYMYIKVKMEGGIARKIDVSLHHSFPTLKQTLLDMFGICQENSSNYRLTYQDREGDWLLAEDVPWRNFLGTVQLLKLMRRSS

SEQ ID NO: 699 - DNA, 255 bp, Populus trichocarpa
gtacatttcttaatattccatccatcactcaaaaggaaaaaagaaaaaagaaaaaaatctatcctttctctatcttttttcctttcttcttcttgaaaaccagtgcatgcttttgttttgagcgagctttgctttttgatgtctatgcccttagagcatgttacataggcatatcatctgaggtttcttcaatggaaaacacctctggtactgatacaataaacatctctaccactgctttaaaggtcttaactt

SEQ ID NO: 700 - protein, 304 aa, Populus trichocarpa
MSMPLEHDYIGISSEVSSMENTSGTDTINISTTASKGLNLKATELRLGLPGSDSPERGNENQQLGFSLNNNNSKDKSFVSARRGFSVAIHGGSANWVFSGNAGSDPNFSLRGANSGKEGFPHSSKPVVQENKSQVDGANTNGHGAAPASKAQVVGWPPIRFRKNTMASHLSKNDDGAEVKSGSGCLYVKVSMDGAPYLRKVDLKTFGSYMELSSALEKMFSCFTIGQCGSHVVPGQDGLSSRLMDLLHGSEYVLTYEDKDNDWMLVGDVPWKMFTDSCRRLRIMKGSEAIGLAPRAMEKCKSRN

SEQ ID NO: 701 - DNA, 255 bp, Populus trichocarpa
tcaagtgcaattacaacaacacaggaaatactgaaggttgaatttgctaccatttcggaagaggaacaagcttcagtttaatccaaagatcgttgaacaaagaaaagagaagaatggaatttgagagagatcttaaccttgaggcgacagagctcagattggcctaccgggcactgccacagaacagttggagaagcaaacacctaactcaaatgttaccaagagcaacaaaagatcattcctgacatgaatgaa

SEQ ID NO: 702 - protein, 199 aa, Populus trichocarpa
MEFERDLNLEATELRLGLPGTATEQLEKQTPNSNVTKSNKRSLPDMNEDSAGRRESSSVSSNDKKSHEQETAPPTKTQVVWPPIRSYRKNCLQARKLEAEAAGLYVKVSMDGAPYLRKIDLKVYKGYPELLEVVEEMFKFKVGEYSEREGYNGSEYVPTYDKDGDWMLVGDVPWEMFINSCKRLRIMKESEARGLGCAV

SEQ ID NO: 703 - DNA, 766 bp, Populus trichocarpa
atgctccttcaaaacagaactgctcctggtccagttgttggttggcctccaattcgttctttcaggaagaatcttgcaagagtagcggcagctattcaaaaccaaccgttgagtctcaaaacaaaccagttgaaacttgcaagaaagggttatttgtcaaatcaatatggaaggtgtccccataggaaggaaagttgacctgaaagcctatgatacctacgaaaaactctccattgctgtgatgaactctttagaggccttcttgcagctcaaagagattcctcttccaatggaatcatggacaagcaagaggaagctaagcaataacgggtgtattggacggaagtggagaatatacccttgtttatgaggataatgaaggagacatgatgcttgttgggatgtcccatggcacatgtttgtgtccacagtgaagaggctgcgtgtattgaagagctctgaagtttctgcgttgagcctggaagcatcaagcaagagaaggtggccgtgaattaagaggaacaaagaaattaagatgaatttttctgtgaagattctccctgaagagttgattttgcgtccttgttttgtttttatcaatcttgtattgagcttgtgcgactcgaagtatatataattatatatttagctcctttttccttgtatctcttctcctgcccaacataacgctattatcttgatgcccctttctttttgcgagctgtgtaacaaccgtgtttggagcccactgaacagtttttgttcg

SEQ ID NO: 704 - protein, 171 aa, Populus trichocarpa
MLLQNRTAPGPVVGWPPIRSFRKNLASSSGSYSKPTVESQNKPVETCKKGLFVKINMEGVPIGRKVDLKAYDTYEKLSIADELFRGLLAAQRDSSSNGIMDKQEEAKAITGVLDGSGEYTLVYEDNEGDMMLVGDVPWHMFVSTVKRLRVLKSSEVSALSGSIKQEKVAVN

SEQ ID NO: 705 - DNA, 255 bp, Populus trichocarpa
gctaacacacaactgcgtgccaattataagcttagagagagaacagagagagtgggttttagagagagagaaagggagtgtcagtttctgagaggaaactaagagagagcgggcaaaaaagtattctcatcatggaagtggagaagggaacaaagatgggtttgaggagacagagctaaggctagggttgccagggaatggtggaggggctgaaggagagatggtgaggaagagaggatttctgagactgtggac

SEQ ID NO: 706 - protein, 235 aa, Populus trichocarpa
MEVEKGTKMGFEETELRLGLPGNGGGAEGEMVRKRGFSETVDLKLKLSSKESGADPNHEKTSSLQREKNLLATDPAKPPAAQVVGWPPVRSFRKNMLAVQKSSTDQECEKVPGGNATFVKVSMDGAPYLRKVDLKMYKTYQELSDALGKMFSSFTIGNCGHGLKDFLNESKLIDLLNGTDYVPTYEDKDGDWMLVGDVPWDMFVESCKRLRIMKGTEATGLAPRAMEKCKNRSYK

SEQ ID NO: 707 - DNA, 829 bp, Populus trichocarpa
atgccggctacatggacaacatatcagggccgtgagctgcatgaggagatgcctttcctcactatattaatactcataaagtggtatgctctctatgctatgtatttgagcctaaggtggcggcttcattagcttcacatctccaaaaatgggcagaggactgcctctagctcttcatcatctttcgaaagcagccgctacccatctgtctccggcgagtcttctttccctcatgtaaaggggaccttagcacagatctaaggcttggacttggcatatcaacctctcgacaggacaacccttccacaccaagtgagcagtattggattggccaccgatcaagccgtctccggggaaggcagtaacatcagaagaaaatgagtgctgtagttccaccttatcgtcaaggtgtacatggaaggcattcaaattggaaggaaactgaacctattagcccacgatggttaccatgacttgataagactctcgacgaaatgttcaacactagcattctctggcctgaaatggatgttgaacattccgggaaatgccatgtgctgcatatgaagacaaagagggcgattggttgattgttggggatgttccatgggaggtgttcttaccttctgtgcggagattgagatcaccagggcagacagcctatgattttggttcatgattcatatgcagtctcctcttctccctagacatgcacttgtaatggtgaatcgaaaataactaggtagtggacagctaggtaactccaaatgaatatgttgaggatgatagaacaaaagctgtcttttgttgtaaattaaggattttcaga

SEQ ID NO: 708 - protein, 172 aa, Populus trichocarpa
MGRGAASSSSSSFESSRYPSVSGESSFPHVKRDLSTDLRLGLGISTSRQDNPSTPSEQLLDWPPIKPSPGKAVTSEENECSSTLFVKVYMEGIQIGRKLNLLAHDGYHDLIQTLDEMFNTSILWPEMDVEHSGKCHVLTYEDKEGDWLIVGDVPWEVFLPVRRLKITRADSL

SEQ ID NO: 709 - DNA, 606 bp, Populus trichocarpa
attcggtctttcaggaagaatcttgcaaccagcagcggcagcaattcaaaaccaacctttgagtctcaaaataaaccagcggaacttgcaagaaggggttatttgtcaagatcaatatggaaggtgtccccataggaaggaaagtggacctcaaagcctagatagctatgaaaaactctcaactgctgttgatgaactctttagaggccttcttgcagctcaaagagattcctcttgtaaggaatcatgaacaagcaagagggagagaaagcaattatgggtgtattggacggaagtggggaatataagcttgtttatgagataatgaaggagacaggatgcttgttggggatgtcccatggcacatgtttgtttccacagtgaagaggctgcgtgtattaagagctctgaagtttctgcactgaaccttggaagcagcaagcacgagaaggtgcccgtgtgaatcaagtgaacaaattggatgagttttgctgtgaagattttccactcgtgtgactaagaaaactgggattccgtggtccttattttgtttatctaattgtattgaactttttgcaactcaaagtatatataattactagttat

SEQ ID NO: 710 - protein, 115 aa, Populus trichocarpa
MEGVPIGRKVDLKAYDSYEKLSTAVDELFRGLLAAQRDSSCNGIMNKQEGEKAIMGVLDGSGEYKLVYEDNEGDRMLVGDPWHMFVSTVKRLRVLKSSEVSALNLGSSKHEKVPV

SEQ ID NO: 711 - DNA, 768 bp, Populus trichocarpa
tttggcttcacacctccaaaatgggcagaggagctacctctagttcttcatcttcttttgaaagcagcaactacccatcttatcaagcaagtcttctctctctcagctaaagaaagacctaagcacagatctcaggcttggacttagcatctcaacctctaacaggagaacccttctacaccaagtgatcagcaactttcggactggccaccaatcaagccatttctaaggaaggcattacgtcagaagaaaatgagtgcagtagtgccaccttcttcgtcaaggtttacatggaaggcattccgattggaaggaagctcacctcttagcccatgatggttaccatgacttaatacagactcttgaccaaatgttcaacactagcattctctggcctgaatggatattgaacattctgggcaatgtcatgtgttgacatatgaagacaaagagggggattggttgattgttggggatgttcctgggagatgttcttaccttctgtgcggagattgaagatcactagggcagacagcctatgattttggttcatgctgatgtcactagggcagacagcctatatgattttggttcatgatcgatgcttatgcggtctccttttctccttgacacatatatatatggcgagtcgaaaataaataggtagtggatagctaggtaactctatatgaagtgttgagaatcacgtttgcacttgtaatcatccttgggataaatgatagaacaaaagttgtcttttgattgtaa

SEQ ID NO: 712 - protein, 173 aa, Populus trichocarpa
MGRGATSSSSSSFESSNYPSVSSKSSLSQLKKDLSTDLRLGLSISTSQQENPSTPSDQQLSDWPPIKPFLRKALASEENESSATFFVKVYMEGIPIGRKLNLLAHDGYHDLIQTLDQMFNTSILWPEMDIEHSGQCHVLTYEDKEGDWLIVGDVPWEMFLSVRRLKITRADSL

SEQ ID NO: 713 - DNA, 255 bp, Populus trichocarpa
acataatttagaagtgcctccccttttcatttcaacacgttaagtgccctcctagaattcatcgtcgcggatagtagcgtcagaaaatgtcaccggaaaatggttcaaacttgctggaatccgatgcggccaacgtgagtttcaaggagacagagttgacttagggctgcctggtgagtctcgtgggctagcattaatagagaaaacaagtggcaagcgtgggtttttggagactgttgactaaatcttggaagg

SEQ ID NO: 714 - protein, 218 aa, Populus trichocarpa
MSPENGSNLLESDAANVSFKETELTLGLPGESRGLALIEKTSGKRGFLETVDLNLGRSSNVDSDHNKYSGESETDVPNTAPPAAKAQVVGWPPVRAYRKNAMKSCKYVKVAVDGAPYLRKVDLEMYNSYQQLLNALQDMFSCFSFTIRNYLNERTIMEQENNGVEYVPTYEDKDGDWMMLGDVPWKMFVESCKRLRLMKSSEATGFAPRTPSKCSSSS

SEQ ID NO: 715 - DNA, 255 bp, Populus trichocarpa
aagccaagccaaaccaaaccaaaccaaatatcaatatcaagccttcaattttgttgtttctcctctcatatatttacgattctttgcttctaaattaaccctttcgtgaacctcttctttccctttcttttctttgatgcaaggtggttttcttggtggagaagtggtgggtcggtgtgtatgtcgacggtgtcaatggaggataacgtgttgatgtcatctgaggactcgtcaagcccgatgagggtgaacttg

SEQ ID NO: 716 - protein, 287 aa, Populus trichocarpa
MQGGFLGGGSGGSVCMSTVSMEDNVLMSSEDSSSPDEGELELGLGLSLGGASGFKDFGQRSSQQYARILTAKDLPSKVSSSCCSSTTSSSSSTLSRANATAGTKRAADSVSASNGAASSQVVGWPPIRSHRMHIMVNQAKSQATEEFNSMNKRKNAVEEKGNKNINIGNTKTRTSLFVKVNMDGTLIGRKVDLNAHGCYETLAQALENMFLRTTTTLNMARLSTPEHKIMIDAKRHSQLLGSSEFVLTYEDKDGDWMLVGDVPWGMFISSVKRLRIMRMSEATGLGK

SEQ ID NO: 717 - DNA, 255 bp, Populus trichocarpa
tattttcactacttctgtgaccaactttgatgtcttctattccaaaggaacatgattacataggcttgtcagagactcctcaatggaaaaaatctctgacaagctctcctcttcctcctctaccctctccactgaagagaatatcaacagcaacagcaacgcaacagcaacagcaccaatacttctctcaacttgaaagaaactgagctaaggcttggcttgccagggtatcagtctccaagagaaaactaacac

SEQ ID NO: 718 - protein, 345 aa, Populus trichocarpa
MSSIPKEHDYIGLSETPSMEKISDKLSSSSSTLSTEENINSNSNSNSNSTNTSLNLKETELRLGLPGYQSPERKLTLPAAVSLFGKDIDTNNTNGYPLRPLKNLVSGTKRGFSDAIVGSSGKWVFSGSNGSEVDLGKGAILFSPRGDNGNSQKSCVAGPAKDDVAQSPKPVQEKISQVAAANENSSAPAAKAQVVGWPPIRSFRKNTMASSLVKNNEDVEGKSGYGCLYVKVSMDGAPYLKVDLKTYSNYLELSSALEKMFSCFTIGQCGSHGLRGQDGLTESRLKDILHGSEYVLTYEDKDGDWMLVGDVPWDMFTNSCRLRIMKGSEAIGLAPRAMEKCKNRN

SEQ ID NO: 719 - DNA, 255 bp, Populus trichocarpa
ctagctagttagcttgcaaaacaaagaagaggacacgggaaatcagaagcaaggagctagctatctacagcaccaaaaacacaagcaataatacaaaacacgttagatcttccactaaagccattcattggcgagcgcgcggtagagagaaatgacaactctgtgctaggtaccgagcgaactgatttgaactacaaagagactgagctgtgtctgggattgcctggtgctgttggtgccagaatgaagttgaga

SEQ ID NO: 720 - protein, 245 aa, Populus trichocarpa
MTTSVLGTERTDLNYKETELCLGLPGAVGAKNEVETPNKATGKRGFAETVDLKLNLQAKEGVMDLNENIKNITSKDKNHLAVTIKDPAKPPAKAQVVGWPPVRSYRKNVMAQKNASEEGEKASTGGSSAAFVKVCMDGAPYLRKVDLKMYRSYQELSDALKMFSSFTMGNYGAQGMIDFMNESKLMDLLNSSEYVPSYEDKDGDWMLVGDVPWEMFVNSCKRLRIMKGSEAIGLAPRAMECKSRT

SEQ ID NO: 721 - DNA, 255 bp, Populus trichocarpa
gcctcaaaggtgctgctattgctaccgacaggcttagcttgcctttgtccataattcatgcatttgaagagagaataacaggcatttctctcaacctcttccttttgtatataaaatacacttgtttccattcacacctgcatcccctcacagaaaaactgctaccatttctctcaagaatcattaccaaaggaaatcacaagagcaacttccaagtcttgtatacatcatctcttagcattcctgtttttgaac

SEQ ID NO: 722 - protein, 190 aa, Populus trichocarpa
MEGGVAYENDLNLKATELRLGLPGTSCTNEEQAVSGARNNKRPLPETREERGAKGKSDPRHDDQETAPAPKAQIVGWPPISYRKNTLQPKKAEAEAAAGMYVKVSMDGAPYLRKIDLKVYKGYPELLKALENMFKLTIGEYSEREGYKGSEYAPTYEDKDDWMLIGDVPWDMFLSSCKKLRIIKGSEATG

SEQ ID NO: 723 - DNA, 694 bp, Populus trichocarpa
atggaacttcaacttggtctcggtcttccaagtgaaaaaacaatgaagggtttggacctaaacagctatgtttcggagccaaagagttgctgggctcgggccaacttcacctgggttcatattcgtggttttctacaaatgataatgacaagaaacggagtttattgatgcctctgaagagagctcgagaaatgaagacgtgcctcgaacgctgcctctcttggtttggaataaccagccaacgaggaagatgatccgcctaaagatcttgataaccactgcaactactctttttcctccaacaaaagtgatggagaaaggatggaatagtggggtggccaccaataaagttcaagaggaagaagcttagtcgtcaaaacagtagagtgctagaggttaacgggcagtggacaatggttgtgaagattgccaagctagatcatcaaactccatgtacattaaggtcaagatggagggagtggaatagcaaggaaaattgatgttagcgtctaccgttgctttccaacacttaaacatacgttgcttgacatgtttgggattgccaggaaaattcaagcaactacagactgacttaccaggatagagaaggtgactggctactagctgaagatgtaccttgaggaactttcttgggtcagtccaacgactaaaactgatgaggagcagcaattga

SEQ ID NO: 724 - protein, 231 aa, Populus trichocarpa
MELQLGLGLPSEKTMKGLDLNSYVSEPKELLGSGQLHLGSYSWFSTNDNDKKRSFIDASEESSRNEDVPRTLPLLVWNNQNEEDDPPKDLDNHCNYSFSSNKSDGESDGIVGWPPIKFKRKKLSRQNSRVLEVNRAVDNGCEDCQARSSNSMYIKVKMEGGIARKIDVSVYRCFPTLKHTLLDMFGICQENSSNYRLTYQDREGDWLLAEDVPWRNFLGSVQRLKLMRSSN

SEQ ID NO: 725 - DNA, 593 bp, Populus trichocarpa
atggagaggtcaatggcatacgaaagacatctaaatctaaaggcaacagaactgagattagggttgcctggaagcgatgaccagagaaaccatcaactactcctagtgttaggagtaacaagagagcatcaccagaaatatcagaggagtctaggtccaaggcagctctagtctgtcctccaatgttgaaaatagtgaaggagatgatgctcctcctgccaaggcacaagtagtgggatgccaccaatccgatcttacaggaaaaattgcttgcaaccaaagaaaaacgatcgagttgatggtgctggaatgtacgtcaagtgagcgtggatggagctccttatctcaggaagattgatcttaaggtgtacaggagctacccagagctcctcaaagcattgaagatatgttcaagcttaccatcggagagtactcggagaaggaaggatacaatggatctgactttgctcctacttacgagataaagatggagactggatgcttgttggagacgttccatgggatatgtttatctccacctgcaagaggctgagaattataagggatcagaagctagaggattgggttgttaa

SEQ ID NO: 726 - protein, 197 aa, Populus trichocarpa
MERSMAYERHLNLKATELRLGLPGSDEPEKPSTTPSVRSNKRASPEISEESRSKGSSSLSSNVENSEGDDAPPAKAQVVGPPIRSYRKNCLQPKKNDRVDGAGMYVKVSVDGAPYLRKIDLKVYRSYPELLKALEDMFKLTIGEYSEKEGYNGSDFAPTYDKDGDWMLVGDVPWDMFISTCKRLRIMKGSEARGLGC

SEQ ID NO: 727 - DNA, 768 bp, Populus trichocarpa
atgtcaaaagtggaggtggtggaggctgaggcaagttcatatccagtggaagctgagctggagctggggctgagtcttggagtggtggtcgtggtggtggtggtggagggaagggtaaggcaaatgcacggggtgagcgtggcagaatcttgactgccaagactttccttcggtgagagctgctgactctgtctcccatgagggtggatcccctactgctggcagtcaggttgtggggtgcctcctataagggcttatcggatgaatagcttggtgaaccaagcaaaggctgcaagagctgaagaagacaagggaattgggagaaggatatatctaaggataatttgaagaagaaaatctgtaatggtaacaagaccagtgctcctagtaatgaaaagggcatcttggatttgtcaaggtgaatatggatgggattccaattggaaggaaggtagatttgaatgctcatgcttgctatgaacattagctcaagcattggaggaaatgtttttcaggtccgccacaactatcaattccattggtggcgagaagcggcaagtacgaagccctccaagttattggatggattgtccgagttcctactcacttatgaagataaagagggagactggatgcttgtggagatgttccgtgggggatgttcctcaactcagtaaaaaggcttaggatcatgaggacctcggaggccaatggacttgcccaagattccaggataggaatgagaaacaaagaataaagcctgtttag

SEQ ID NO: 728 - protein, 255 aa, Populus trichocarpa
MSKVEVVEAEASSYPVEAELELGLSLGSGGRGGGGGGKGKANARGERGRILTAKDFPSVRAADSVSHEGGSPTAGSQVVGPPIRAYRMNSLVNQAKAARAEEDKGIGEKDISKDNLKKKICNGNKTSAPSNEKGHLGFVKVNMDGIPIGRKVDLNAHACYTLAQALEEMFFRSATTINSIGGEKRQVTKPSKLLDGLSEFLLTYEDKEGDWMLVGDVPWGMFLNSVKRLRIMRTSEANGLPRFQDRNEKQRIKPV

SEQ ID NO: 729 - DNA, 255 bp, Populus trichocarpa
atggaatttgagagagatcttaatcttgatgcaacagagcttaggttaggcctccccggcactgccacaaaacagtcagaaagcaaacacctaactcaaatcttgccaagagcaacaaaagatcattgcctgacatgaatgaagagcccgcaggatcatcagggaaaattctagcactgtctcatcaaatgacaaaaaaagccatgaccaagaaactgctccacccatcaaggcacaagtgtagggtggccacca

SEQ ID NO: 730 - protein, 201 aa, Populus trichocarpa
MEFERDLNLDATELRLGLPGTATKQSEKQTPNSNLAKSNKRSLPDMNEEPAGSSRENSSTVSSNDKKSHDQETAPPIKAQVGWPPIRSYRKNCLQAKKLEAEAAGLYVKVSMDGAPYLRKIDLKVYKGYPELLKALEEMFKSKVGEYSEREGYNGSEHVPYEDKDGDWMLVGDVPWDMFINSCKRLRIMKESEARGLGCAV

SEQ ID NO: 731 - DNA, 255 bp, Populus trichocarpa
acaccagacagcaaataagcttttgttactttgtgccaaaatggaggatccttagctctctctctctggctatctctctccctctacttctctttccaaactccctctctctctctgcttctaaaacagaaacaaaaccctcacaattgaaatcttcactctcttctccagctacaaatccacaaatctaagtcacaggtaacaaaaagaattccgagtgtttttattctcaattctgattctccaccactactt

SEQ ID NO: 732 - protein, 362 aa, Populus trichocarpa
MSPPLLGVVEEEGHSNVTLLASPASAESACLNGLELKERNYMGLSDCSSVDSSAVSAASDERKTSLNLKATELRLGLPGSSPERNHELSLLSSALLDEKPFFPLHPSNDGHYSSTQKNVVSGNKRVFSDAMDEFSESKFLSNSEVNAMLSPRPSPNMGLKGMLENLGVQQAKVKEIVAPKAGQERPHAANETRPLRNSSANNSSAPAPKAQVVGWPPIKSFRKNSLATTSKNTEEVDGKAPGALFIKVSMDGAPYLRKVDLRNYSAYQELSSALEKMFSCFTIGQYGSHGAPGREMLSESKLKDLLHGSEYVLTYEDKDGWMLVGDVPWEMFIETCKRLRIMKSSDAIGLAPRAMEKCKNRN

SEQ ID NO: 733 - DNA, 911 bp, Populus trichocarpa
agagttaacaaactatataacattttgaaaccgtggagccaaaaaaaaaccaagttcagaggaagaaaattgaaacctttcccatcaccaagaaaagaaaatggcacaacctcttggacttgaaatcacagagctaaggttgggtctaccgggcagcgatatggacataaaaatgacaagaaaagggttttctctgaggtgtccggcgaagcaaacagcacaaccgatgaccgaaaagttaaacaaagagtcaagttgtggggtggccaccagtttgttcgtatcgaaaaaacattagtttcaatgagagagatcgccatatgaaacttcaaaaatttacgtgaaagtaagcatggatggagctccttttcttcgaaaaattgatttgggcatgcataaaagtattcggatcttgttgtcgcgttggagaggttgtttggctgttatggaattggcaaagccttgaaggatgaatacgttccatatatgaagacaaggatggagactggatgctagtgggagacgtgccttgggagatgttttttgagtcttgcaagaggtaaggatcatgaagagttcagaagccaaaggttttgggctgcagccaagaggcgctcttaagggaatttcaaaagatgaagtcactgagaaactacaacatattgaactcgggagaacttgactgaattgtcttaatttttcgtgagcataaacatttcttttaattggtaattattggttaattaagaacagacgattcaccatcaagttgtagcttaatttgagacctgtttttatattttaaactgggacttataggaccctagatagaaaagacaactagcttgtttttcacgattaaatccatcctgctatatgttttttttccattattatttttgaatcatgaa

SEQ ID NO: 734 - protein, 182 aa, Populus trichocarpa
MAQPLGLEITELRLGLPGSDDGHKNDKKRVFSEVSGEANSTTDDRKVQTKSQVVGWPPVCSYRKNISFNERDRHHETSKIVKVSMDGAPFLRKIDLGMHKEYSDLVVALERLFGCYGIGKALKDEYVPIYEDKDGDWMLVGDVPWEMFFESCKRLRIMKSEAKGFGLQPRGALKGISKDERH

SEQ ID NO: 735 - DNA, 865 bp, Populus trichocarpa
atggcatacgaaagcgatctaaatctaaaggcaacagaactgaggttagggttgcctggaagtgatgagccagagaaacctcaactactcctagtgttaggagtaataagagagcctcgccagaaatatcagaggagtccaggtccaagggcagttctaggtgtcctccaatgtcgaaaatggtgaaagagacagtgcccctcctgccaaggcacaagtagtgggatggccaccaatccgtcttataggaaaaattgcttgcaaccaaagaaaaatgatcaagttgatggtgctggcatgtacgtaaaagtgagcgtggaggagctccttatctcaggaagattgatcttaaggtgtacaagagctacccagagctcctcaaagccttggagaatatgttaagcttaccattggtgaatactcagagaatgaagggtacaacggatctgaatttgctcctacttacgaagataaagatgggactggatgctagttggcgacgttccatgggacatgtttatctcctcctgcaagaggctgagaattatgaaaggatcagagctagaggattgggctgttgataaaacaaaaaacaaaacttgaaacctgtcaacaaaaggagatatggtgatttaggggagagtaatttggctttggatatattctccgagagattaggtctcttaggaacagaaacaagttgatcagatcttcttttttggcttcggttctccctccttggttttggtttccaagatctggatatgtatcaattaaactatagagacagaaagatcacattttttatctgaattatatataaacgagcgagtctccaatattcagtgctagttacagaaaaaaa

SEQ ID NO: 736 - protein, 193 aa, Populus trichocarpa
MAYESDLNLKATELRLGLPGSDEPEKPSTTPSVRSNKRASPEISEESRSKGSSSVSSNVENGERDSAPPAKAQVVGWPPISYRKNCLQPKKNDQVDGAGMYVKVSVDGAPYLRKIDLKVYKSYPELLKALENMFKLTIGEYSENEGYNGSEFAPTYEDKDDWMLVGDVPWDMFISSCKRLRIMKGSEARGLGC

SEQ ID NO: 737 - DNA, 1482 bp, Arabidopsis thaliana
gttcccctcttatcaaacttcacccccaacaagagttatcgagagagagagaaaacatattctgatttaagacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgattttttttttttggtattgttatgatcatgtgtttttaatttaaaatattggaagtatataggaaaatataattgtttacgaaaaaaataactttaaatatgtctttttttttttttttgaaattagtctgtgtttttgttttcatctcttaattagtagaaatcattttttaatatgtaattgtgatagtaaatctatagagttcgtatttttgctatttaaaatttaaaatgctaatactatatataatttatgataggtaaatttacgttaaataatttatctccacttttcctactttattattcttttcctctttattttctcatttattggctttacagattatatttgaaatttgtaactatttttgatgtatctaaaaacatttcacataacaatttcttaagaaaactaagaaaactgttggtatattttttgactaaaatggtttccaaaaagattttgaaacgaactaaaatcttcattacaaaaccaattttaaaactacaaaacaaatattcatggttttaagtttcttttttctttcctagttacgtgggaatacgttattaaattcaggacccatgagaggcgtagggaacaagagcatgtgcatattcatgggtctttcaaattcagtccatcctcttcatgctaatgtgccc

SEQ ID NO: 738 - protein, 228 aa, Arabidopsis thaliana; identical to SEQ ID NO: 484

SEQ ID NO: 739 - protein, 10 aa, Artificial sequence
  Motif 13
  VARIANT (1)..(1): / replace = "Arg" / replace = "Glu" / replace = "Asp"
  VARIANT (2)..(2): / replace = "Glu" / replace = "Asp"
  VARIANT (6)..(6): / replace = "Arg"
  VARIANT (9)..(9): / replace = "Ile"
  VARIANT (10)..(10): / replace = "Gly"
KATELCLGLP

SEQ ID NO: 740 - protein, 7 aa, Artificial sequence
  Motif 14
  VARIANT (5)..(5): / replace = "Ala"
KRGFSET

SEQ ID NO: 741 - protein, 7 aa, Artificial sequence
  Motif 15
  VARIANT (6)..(6): / replace = "Ile"
VGWPPVR

SEQ ID NO: 742 - protein, 13 aa, Artificial sequence
  Motif 16
  VARIANT (8)..(8): / replace = "Ile"
  UNSURE (11)..(11): Xaa can be any amino acid, preferably one of Lys, Thr, Arg, Ser or Gln
  UNSURE (12)..(12): Xaa can be any amino acid, preferably one of Asn, Leu, Thr, Val, Ile or Cys
  VARIANT (13)..(13): / replace = "Phe"
GAPYLRKVDLXXY

SEQ ID NO: 743 - protein, 22 aa, Artificial sequence
  Motif 17
  VARIANT (1)..(1): / replace = "Asn" / replace = "Gly"
  VARIANT (2)..(2): / replace = "Trp" / replace = "Thr"
  VARIANT (3)..(3): / replace = "Asp" / replace = "Gly"
  VARIANT (4)..(4): / replace = "Phe" / replace = "His"
  VARIANT (5)..(5): / replace = "Ala" / replace = "Glu"
  VARIANT (6)..(6): / replace = "Leu" / replace = "Val" / replace = "Ile"
  VARIANT (7)..(7): / replace = "Thr" / replace = "Ala"
  VARIANT (13)..(13): / replace = "Gly"
  VARIANT (15)..(15): / replace = "Leu"
  VARIANT (17)..(17): / replace = "Phe"
  VARIANT (18)..(18): / replace = "Ile"
SSEYVPSYEDKDNDWMLVGDVP

SEQ ID NO: 744 - protein, 13 aa, Artificial sequence
  Motif 18
  VARIANT (1)..(1): / replace = "Thr"
  VARIANT (3)..(3): / replace = "Arg" / replace = "Gln"
  VARIANT (4)..(4): / replace = "Lys"
  VARIANT (5)..(5): / replace = "Ile"
  VARIANT (7)..(7): / replace = "Leu"
  VARIANT (8)..(8): / replace = "Ile"
  VARIANT (10)..(10): / replace = "Ser" / replace = "Glu"
  VARIANT (11)..(11): / replace = "Lys" / replace = "Thr"
  VARIANT (12)..(12): / replace = "Asp"
  VARIANT (13)..(13): / replace = "Thr"
SCKRLRIMKGSEA

SEQ ID NO: 745 - DNA, 56 bp, Artificial sequence
  primer: prm07273
ggggacaagtttgtacaaaaaagcaggcttaaacaatgaaccttaaggagacggag

SEQ ID NO: 746 - DNA, 51 bp, Artificial sequence
  primer: prm07274
ggggaccactttgtacaagaaagctgggttcaatgcatattgtcctctttt

SEQ ID NO: 747 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcggccttctcgcaggattcagcc

SEQ ID NO: 748 - protein, 243 aa, Arabidopsis thaliana; identical to SEQ ID NO: 478

SEQ ID NO: 749 - protein, 210 aa, Arabidopsis thaliana; identical to SEQ ID NO: 480

SEQ ID NO: 750 - protein, 277 aa, Populus trichocarpa
MATATVLGTEMADLNYKETELCLGLPGAVGVKNEVETPNKATGKRGFAETVDLKLNLQAKEGVMDLNENIKNIASKDKNHLPADTIKDPAKPPAKAQVVGWPPVRSYRKNVLAQKNASEEGFRAQVVGWPPLRSYRKNVLTQKNASEEGDKASTGGSSAAFVKVCMDGAPYLRKVDLKMYKSYQELSDALAKMFSSFTMGNYGAQGMIDFMNESKLMDLLNSSEYVPSYEDKDGDWMLVGDVPWEMFVDSCKRLRIMKGSEAIGLAPRAMEKCKSRT

SEQ ID NO: 751 - protein, 248 aa, Populus trichocarpa
MTTSVLGTERTDLNYKETELCLGLPGAVGAKNEVETPNKATGKRGFAETVDLKLNLQAKEGVMDLNENIKNITSKDKNHLPAVTIKDPAKPPAKAQVVGWPPVRSYRKNVMAQKNASEEGEKASTGGSSAAFVKVCMDGAPYLRKVDLKMYRSYQELSDALAKMFSSFTMGNYGAQGMIDFMNESKLMDLLNSSEYVPSYEDKDGDWMLVGDVPWEMFVNSCKRLRIMKGSEAIGLAPRAMEKCKSRT

SEQ ID NO: 752 - protein, 236 aa, Medicago truncatula
MATMGHGLNLKETELCLGLPGGGGGGGGGGSEVETPRASGKRGFSETVDLKLNLQTKEDLNEKSASKEKTLLKDPAKPPAKAQVVGWPPVRSYRKNMMAQKVNNTEDTEKTTSNTTAAAFVKVSMDGAPYLRKVDLTMYKTYKDLSDALAKMFSSFTTGNYGAQGMIDFMNESKLMDLLNSSEYVPTYEDKDGDWMLVGDVPWEMFVGSCKRLRIMKGSEAIGLAPRAMEKCKNRS

SEQ ID NO: 753 - protein, 236 aa, Solanum lycopersicum
MDLKETELCLGLPGGGGGGGELIRDNNNNNNKVNGKRGFSETVDLKLNFHQASDDISCAMENNKMKSSVTTTKEVVCNKDPIKPPAKAQVVGWPPVRSFRKNVMAQKSNTEESEKTTAAFVKVCMDGAPYLRKVDLKMYKSYQELSDALAKMFSSFTNGNYGSQGMIDFMNESKLMDLLNSSEYVPTYEDKDGDWMLVGDVPREMFGDSCKRLRIMKGSEAIGLAPRAMEKCKSRI

SEQ ID NO: 754 - protein, 229 aa, Arabidopsis thaliana; identical to SEQ ID NO: 440

SEQ ID NO: 755 - protein, 67 aa, Oryza sativa
MNESKIADLLNGSEYVPTYEDKDGDWMFVGDVPWEMFVESCKRLRIMKGSEAIGLAPRAMEKCKNRS

SEQ ID NO: 756 - protein, 277 aa, Oryza sativa; identical to SEQ ID NO: 570

SEQ ID NO: 757 - protein, 253 aa, Medicago truncatula
MTNVGDAERDKYSLINFEETELRLGLPGAGDHGESPVKNSCGKRGFSETANVDLKLNLSPINDSASSSSTIASVAENKGKDTTTSATVSPPPRAKAQVVGWPPVRSFRKNIVNVHQKSNSETEVDKSISGGGGNGAFVKVSMDGAPYLRKVDLKLYKSYQELSDALAKMFSSFTIDNCGSQVTKDFMNESKLIDLLNGSDYVPTYEDKDGDWMLVGDVPWEMFVQSCKRLRIMKGSEAIGLAPRAVEKCKNRS

SEQ ID NO: 758 - protein, 236 aa, Arabidopsis thaliana; identical to SEQ ID NO: 468

SEQ ID NO: 759 - protein, 208 aa, Solanum lycopersicum
MSSNKLDFEETELRLGLPGGARKNVYGDNDTCNVNGKRGFVDLKLNLSSDINNIKNSTHKTPAAKAQVVGWPPVRSFRKNILTSQKLDRENDNILVKVSMDGAPYLRKVDLNMYKSYQELFDALTKMFNSFTIVQGMKDFMHEGKLMDLLNSSDYVPTYEDKDGDWMLVGDVPWGMFVDSCKRLRIMKGTEAIGLAPRAMEKCKNRNG

SEQ ID NO: 760 - protein, 299 aa, Medicago truncatula
MEVVGMKKENMGFEETELRLGIGFLGNNGSATATEGVVRKRGFSETETDDDTTTMDLMLNLSSKEATAEVDPSDITTKTLQKEKTLLPADPAKPPAKAQVVGWPPVRSYRKNMLAMQKSESEKNSSSNFNAITFVKVSMDGAPYLRKVDLKMYTSYSQLSDSLGKMFSSFTIGNCESQGMKDFMNESKLMDLLNNSDYVPTYEDKDGDWMLVGDVPWEMFVESCKRLRIMKGKEAIGYSTKSYGKMQEQELDLLVALVRHLLHLLSYFGTCRMFSIVNLCNVIWFLFFDKIVIWFVIHI

SEQ ID NO: 761 - protein, 245 aa, Medicago truncatula
MEVVAGMKKEEKMVFDETELRLGLGLPGKTTEVVRKRGFSETESESETNTVDLKLNLSTKEGATDPQFKPKEKALLLSDSGAKPPAKAQVVGWPPVRSFRKNMFAAQKSNEGSEESEKKNSNNNPISFVKVSMDGAPYLRKVDLKMYKSYPELSDALAKMFNSFTTGNCESQGIKDFMNESNKLMDLLNSSDYVPTYEDKDGDWMLVGDVPWEMFIDSCKRLRIMKGKEAIGLAPRAMEKCKNRS

SEQ ID NO: 762 - protein, 237 aa, Populus trichocarpa
MEVEKGTKMGFEETELRLGLPGNGGGAEGEMVRKRGFSETVDLKLKLSSKESGADPNHEKTSSLQREKNLLATDPAKPPAKAQVVGWPPVRSFRKNMLAVQKSSTDQECEKVPGGNATFVKVSMDGAPYLRKVDLKMYKTYQELSDALGKMFSSFTIGNCGSHGLKDFLNESKLIDLLNGTDYVPTYEDKDGDWMLVGDVPWDMFVESCKRLRIMKGTEATGLAPRAMEKCKNRSYK

SEQ ID NO: 763 - protein, 174 aa, Arabidopsis thaliana; identical to SEQ ID NO: 476

SEQ ID NO: 764 - protein, 168 aa, Arabidopsis thaliana; identical to SEQ ID NO: 486

SEQ ID NO: 765 - protein, 189 aa, Arabidopsis thaliana; identical to SEQ ID NO: 438

SEQ ID NO: 766 - protein, 190 aa, Solanum lycopersicum
MECVLAHEKDLNLKATELRLGLPGRTDEESDKEIVFHFKNNKRALPEDEDCESNSISDPKTPPVAKTQIVGWPPVRANRKNSFPSKKAEAECGMYVKVSMDGAPYLRKIDLKLYKGYPELLKALEKMFKLSIGEYSEREGYKGSEFAPAYEDKDGDLMLVGDVPFEMFLSSCKRLRIMKGSEARGLGCGV

SEQ ID NO: 767 - protein, 196 aa, Solanum lycopersicum
MTSIVGNQKDLNFKATELRLGLPGTEDQESDQEISNSKNNNKRALPESTHDEEDCESKSSSDHVKTPPPVAKAQIVGWPPVRSNRKNIIQPKKTESESGMYVKVSMDGAPYLRKIDLKMYKCYQELLKALENMFKLTIGEYSEREGYKGSEFAPAYEDKDGDLMLVGDVPWEMFMSSCKRLRIMKGSETRGLGCGV

SEQ ID NO: 768 - protein, 192 aa, Populus trichocarpa
MEGGVAYENDLNLKATELRLGLPGTSCTNEEQAVSGARNNKRPLPETREERGAKGKSDPRHDDQETAPAPKAQIVGWPPIRSYRKNTLQPKKAEAEAAAGMYVKVSMDGAPYLRKIDLKVYKGYPELLKALENMFKLTIGEYSEREGYKGSEYAPTYEDKDGDWMLIGDVPWDMFLSSCKKLRIIKGSEATG

SEQ ID NO: 769 - protein, 207 aa, Populus trichocarpa
MEGGVAYENDLNLKETELRLGLPGTGCTNEKGVSGARNNKRPFPETREEGGANGKSDAQHDDQETASAPNTYSFDMHATCRVQIVGWPPIRSYRKNSLQPKKAEDEAAAGMYVKVSMDGAPYLRKIDLKVYKGYPELLKALENMFKLTIGEYSEREGYKGSEYAPTYEDKDGDWMLVGDVPWDMFLSSCKKLRIMKGSEAIGLGCGA

SEQ ID NO: 770 - protein, 195 aa, Populus trichocarpa
MAYESDLNLKATELRLGLPGSDEPEKPSTTPSVRSNKRASPEISEESRSKGSSSVSSNVENGERDSAPPAKAQVVGWPPIRSYRKNCLQPKKNDQVDGAGMYVKVSVDGAPYLRKIDLKVYKSYPELLKALENMFKLTIGEYSENEGYNGSEFAPTYEDKDGDWMLVGDVPWDMFISSCKRLRIMKGSEARGLGC

SEQ ID NO: 771 - protein, 199 aa, Populus trichocarpa
MERSMAYERHLNLKATELRLGLPGSDEPEKPSTTPSVRSNKRASPEISEESRSKGSSSLSSNVENSEGDDAPPAKAQVVGWPPIRSYRKNCLQPKKNDRVDGAGMYVKVSVDGAPYLRKIDLKVYRSYPELLKALEDMFKLTIGEYSEKEGYNGSDFAPTYEDKDGDWMLVGDVPWDMFISTCKRLRIMKGSEARGLGC

SEQ ID NO: 772 - protein, 178 aa, Medicago truncatula
MENKVAYENDLNMKATELRLGLPGTEQNEEQKAKISNKRPLTETSKDSGSKTSDDAAPPSKAKIVGWPPIRSYRKNSLQEAEASGIYVKVSLDGAPYLRKIDLRVYGGYAQLLKALESMFKLTIGNYSEKEGYKGSEYEPTYEDKDGDWMLVGDVPWEMFVTSCKRLRIMKGTEARGV

SEQ ID NO: 773 - protein, 186 aa, Medicago truncatula
MEFKATELRLGLPGTDEKDMKTIHGSVVKNNKRQLPQTSEESVSISKVSNDDQHVESSSAAPPAKAKIVGWPPIRSYRKNTLQEAEVGGIYVKVSMDGAPYLRKIDLRIYGGYPELLKALETMFKLTIGEYSEREGYKGSEYAPTYEDKDGDWMLVGDVPWDMFVTSCKRLRIMKGTEARGLGCGV

SEQ ID NO: 774 - protein, 203 aa, Populus trichocarpa
MEFERDLNLDATELRLGLPGTATKQSEKQTPNSNLAKSNKRSLPDMNEEPAGSSRENSSTVSSNDKKSHDQETAPPIKAQVVGWPPIRSYRKNCLQAKKLEAEAAGLYVKVSMDGAPYLRKIDLKVYKGYPELLKALEEMFKSKVGEYSEREGYNGSEHVPTYEDKDGDWMLVGDVPWDMFINSCKRLRIMKESEARGLGCAV

SEQ ID NO: 775 - protein, 201 aa, Populus trichocarpa
MEFERDLNLEATELRLGLPGTATEQLEKQTPNSNVTKSNKRSLPDMNEDSAGRRESSSVSSNDKKSHEQETAPPTKTQVVGWPPIRSYRKNCLQARKLEAEAAGLYVKVSMDGAPYLRKIDLKVYKGYPELLEVVEEMFKFKVGEYSEREGYNGSEYVPTYEDKDGDWMLVGDVPWEMFINSCKRLRIMKESEARGLGCAV

SEQ ID NO: 776 - protein, 204 aa, Medicago truncatula
MENSLGNHQTEMNLKATELRLGLPGSDEVEKLPCNFSVLRNNKRSSPEEASDVDSISKSKLNSSNGSSHTTNDDQDNAPPSKAQVVGWPPIRSYRKNSLQQKKGEEVGMYLKVSMAGAPYLRKIDLKVYKSYSELLKVLENMFKCTIGEYSEREGYNGSEFVPTYEDKDGDWMLVGDVPWEMFMSSCKRLRIMKGSEAKGLGCF

SEQ ID NO: 777 - protein, 185 aa, Solanum lycopersicum
MRIYEKDINDLEATELRLGLPGIINDESSTSTSTSKNSRKRPSSSSVNENEQQDSAPAPKAQVVGWPPVRSYRKNHVSKLSESDNNSSGMYLKVSMDGAPYLRKIDLQVYKSYQELLKALQSMFKCTIGVYSEREGYNGSDYAPTYEDKDGDWMLVGDVPWEMFISSCKRLRIIKGSEAKGLACL

SEQ ID NO: 778 - protein, 305 aa, Arabidopsis thaliana; identical to SEQ ID NO: 490

SEQ ID NO: 779 - protein, 132 aa, Medicago truncatula
MMKLRENQNFDCLYVKVSMDGAPYLRKVDLKTYNNYMELSSALEKMFTCFTIGQCNSPGLPGKDGLSESSLRDLLHGSEYVLTYEDKDGDWMLVGDVPWGMFADSCRRLRIMKGSDAIGLAPRAMEKSRSQN

SEQ ID NO: 780 - protein, 349 aa, Populus trichocarpa
MSSIPKEHDYIGLSETPSMEKISDKLSSSSSTLSTEENINSNSNSNSNSTNTSLNLKETELRLGLPGYQSPERKLTLPAAGVSLFGKDIDTNNTNGYPLRPLKNLVSGTKRGFSDAIVGSSGKWVFSGSNGSEVDLGKGAILFSPRGDNGNSQKSCVAGPAKKDDVAQSPKPVQEKISQVAAANENSSAPAAKAQVVGWPPIRSFRKNTMASSLVKNNEDVEGKSGYGCLYVKVSMDGAPYLRKVDLKTYSNYLELSSALEKMFSCFTIGQCGSHGLRGQDGLTESRLKDILHGSEYVLTYEDKDGDWMLVGDVPWDMFTNSCRRLRIMKGSEAIGLAPRAMEKCKNRN

SEQ ID NO: 781 - protein, 307 aa, Populus trichocarpa
MSMPLEHDYIGISSEVSSMENTSGTDTINISTTASKGLNLKATELRLGLPGSDSPERGNENQQLGFSLNNNNSKDKSFVSGARRGFSVAIHGGSANWVFSGNAGSDPNFSLRGANSGKEGFPHSSKPVVQENKSQVDGANTNGHGAAPASKAQVVGWPPIRSFRKNTMASHLSKNDDGAEVKSGSGCLYVKVSMDGAPYLRKVDLKTFGSYMELSSALEKMFSCFTIGQCGSHVVPGQDGLSESRLMDLLHGSEYVLTYEDKDNDWMLVGDVPWKMFTDSCRRLRIMKGSEAIGLAPRAMEKCKSRN

SEQ ID NO: 782 - protein, 347 aa, Medicago truncatula
MSLPRLGIGDEESKSNVTLLEKSLHLNGSKPKEFNYMGLPSSNCSSVDSSVPKIQSFKDETKSNLNLKATELRLGLPGSLSPERDSSDFCLRSSKQFDEKPLFPLHPQKDDHLFESKPAVLGNKRGFSDAMNVFSEGKLKPSSKMLENVAGQKVKADEIATVKIGLERPNGVGESKPGLNGSANNGNSTAPASKAQVVGWPPIRSFRKNSLTTASKNTEEVDGKLGSGGAVFVKVSMDGAPYLRKVDLKNYTAYSELSSSLEKMFSCFTIGQCESHGNQMLNETKLRDLLHGSEYVITYEDKDGDWMLVGDVPWEMFIDTCRRLRIMKSSDAIGLAPRAVEKSKSRN

SEQ ID NO: 783 - DNA, 1258 bp, Arabidopsis thaliana
tatattattattgccccttcctctcctttcttcttcccctcttaccttttcagagagagaaacaatatttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttgaattaataataaaaaaaaagaagcatcaatgatcaacaatatgacgggttcttgattttatatgtatttttatgattgtatgtggctatcacctatatatgtgtgttgtaattttaaatacttgatgggtatatagggcagtattttaccagtaagatgtggacaaacttgtaatgtgaccaaaagagaggaaacttcaatatctctgtgtttgtgtcatatttattgcccaacatgtgtctgtcggtttgatgatcaatcacaacttgatatgtgcatacatataaatgtgtgtatgtaggtgtgtgtacatgtacatgtgttttgatccctactctgctacttgtcgtttcttgtgtgtgttatctaatagttttttcccaaaatgaataattcgttgttatgtttactattttaccaataaaatcttagcttttt

SEQ ID NO: 784 - DNA, 990 bp, Arabidopsis thaliana
cttcccctcttaccttttcagagagagaaacaatatttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggagtgagtcaaatttaatcgtttcatatacttttttttataacttataacttgactcgttaaccacatttcccgaaattggtagagacaaagccaaagatattcaacatccatgtgttataaatacgtacaaccatgcattggttggcaagagacaagaggatctttcaaaaattatacaatagtatcgatatgtttagagctcattcgtagctggcacatcatcatattattgccaaaaaccttagaataaactttaaatgttaacgactcatattctaatgttctaaccgtaaacttgaatacc

SEQ ID NO: 785 - DNA, 1266 bp, Populus trichocarpa
gaagcccaacttatattattgaggtctctctctctctctctctctctcagctagcttgcaaaacatagaagaggacacaagaaataagaaacaaagaaacgagcaaaagctagctatcagcaacaccaaaagcaacaagcaataatacaaaacatatcagatcttccactaaaaccattcattggcgcgcgcgtggcagagagaaatggcaacagctaccgtgttaggtaccgagatggcagatttgaactacaaagagactgagctgtgtctaggattgcctggtgctgttggtgtcaaaaatgaagttgagacacctaataaggctactgggaaaagagggtttgctgagactgttgatttgaagcttaatcttcaggctaaagaaggtgtcatggatctgaatgagaatatcaagaatattgcttcaaaggacaagaaccaccttcctgctgataccatcaaggaccctgctaagccaccagccaaggcacaagttgtaggttggccaccagttagatcttacaggaagaacgttttggctcagaagaacgccagtgaggaaggtttcagggcacaagttgtaggttggccaccacttagatcttacaggaagaacgttttgactcagaagaacgccagtgaggaaggtgataaggcaagcactggcggaagcagtgcagcatttgtgaaggtttgcatggatggtgcaccctatcttcgcaaggtggacttgaagatgtacaagagctaccaagaattatctgatgccttggccaaaatgttcagttccttcaccatgggtaattatggagcccaaggaatgatagactttatgaatgaaagcaagctgatggatctacttaacagttccgagtatgtgccatcctatgaagacaaggatggtgattggatgcttgtgggtgatgttccatgggagatgtttgttgattcatgcaagcgcctgcgcataatgaaaggatctgaagccattggacttgcaccaagagcaatggagaaatgcaagagcagaacctgaatcttatgtactcaatagacaaggcacttgcgcaacatggatggatcagtagtggtgtttctttggatgtgcatgtctttactcttttttttttttttttattaatattgctgctgttatttcttaagaaatgtgtctgtattttcatttgatcgtatatagatatcaaagatctagacatttgtaatggacaagaagcaaaaaacttaacccccgattggctggct

SEQ ID NO: 786 - DNA, 1273 bp, Populus trichocarpa
ctagctagttagcttgcaaaacaaagaagaggacacgggaaatcagaagcaaggagctagctatctacagcaccaaaaacaacaagcaataatacaaaacacgttagatcttccactaaagccattcattggcgagcgcgcggtagagagaaatgacaacttctgtgctaggtaccgagcgaactgatttgaactacaaagagactgagctgtgtctgggattgcctggtgctgttggtgccaagaatgaagttgagacacctaataaggctactgggaaaagagggtttgctgagactgttgacttgaagcttaatcttcaggctaaagagggtgtcatggatctgaatgagaatatcaagaatattacttcaaaggacaagaaccaccttcctgctgttaccatcaaggaccctgctaagccaccggccaaggcacaagttgtaggttggccaccagttcgatcttacaggaagaacgttatggctcagaagaacgccagtgaggaaggcgagaaggcaagcactggcggcagcagtgcagcatttgtgaaggtctgcatggatggtgcaccctatcttcgcaaggtggacttgaagatgtacaggagctaccaagaattatctgatgccttggccaaaatgttcagttccttcaccatgggtaattatggagcccagggaatgatagactttatgaatgagagcaagttgatggatctacttaatagttccgagtatgtgccatcctacgaagacaaggatggtgattggatgctcgtgggtgatgttccatgggagatgtttgtcaattcatgcaagcgcctgcgcatcatgaaaggatctgaagccattggacttgcaccaagagccatggagaaatgcaagagcagaacctgaaccttgtatactcaatttatttagcttccctactgaactccctcttttcagccttgtatccatgaagaccaggagacaaggcacttgtgcaacgtgggtggagcagtagtggtgtttcctggatctgtctgtactttttttttttattattatttttgaggagatgtgtctgtattttcgtttgatcgtatatagatatcaaagatctagacatttgtaatggacaagaagcaagaacttaaccccctgttgtctggcttgtttattactaatggcttgcgtaataatttacctatttctctgttgtttgttgttgtattggctgccatagttgccgagtacgtacgtgttttattccttcaattcaatgctac

SEQ ID NO: 787 - DNA, 1195 bp, Medicago truncatula
cggccgggggaggacacacccttaaggagaaacatcatacacattttcagtttcatagagagaaaaaaaagtaaaaagagtcaatattatatcttttcaattatattctacaatcttcttattcttctaagctttgtatttcattgagaagctagccaaaaagaatatggctactatggggcatggtttgaacctgaaggagactgagctttgtctgggtctgcctggtggtggcggcggcggcggtggaggtggctctgaggtggaaactccaagggcttctggaaagagaggtttctctgagacagttgatctgaagcttaatcttcaaaccaaggaagatctgaatgagaagagtgcttcaaaggagaagaccctccttaaggaccctgctaagccaccagctaaggctcaagtagttggttggccaccagtgaggtcatacaggaagaacatgatggcacaaaaggttaacaatactgaggacactgagaagacaacaagtaacactactgctgctgcttttgttaaggtttccatggatggagcaccttaccttcgtaaggttgacttgacaatgtacaaaacctacaaagatttatctgatgccttagccaaaatgttcagctccttcaccactggtaactatggggcccaaggaatgatagacttcatgaatgagagcaagttgatggatcttcttaacagctctgagtatgtgccaacctatgaagataaggatggcgactggatgctcgtgggagatgtcccatgggagatgtttgttggatcatgcaagcgtcttcgcataatgaaaggatcagaagctattggacttgcaccaagagcaatggagaaatgcaaaaaccgaagctgaatttggtctaaatacatatcatatcctcctatatcgaagtcccgtaccaaagtggacctatatgaaaagatatatgaagcactacctgtggattggagtgttagtttggatgtgtcttcactgtttttgttttgttcgtatatagattcaaactttaattttaagtatttgtaatcgacaagaagcaataaacttaaccacctatatactattgtagtttgccttgtttaattattattattatgtgattgcttccatgctgtcatgtttgttgtgtgctatatatatattattatatactttgaattttaatgcata

SEQ ID NO: 788 - DNA, 1084 bp, Solanum lycopersicum
tgaaaacttttgttactattaactatacttatattatttttgcattttctctctcaatatttttctctctctctctctataatatttgcattgtactactactactacatattgaagaaaaaagagtttgatttttgatggatttgaaagaaactgagttgtgtttgggactacctggtggtggtggtggcggaggtgaattaattcgcgataataataataataataacaaggttaatgggaaaagagggttttctgagactgttgatttgaagctcaattttcatcaagctagtgatgatatttcttgtgctatggagaataataagatgaagagcagtgttactactactaaagaagttgtttgtaacaaagatccaatcaagccacctgccaaggcacaagttgtgggttggccaccagtgagatcatttaggaagaatgtaatggctcaaaagagcaacactgaagaaagtgagaagactactgctgcatttgtcaaagtttgcatggatggtgcaccttacctacgtaaggttgatttgaaaatgtacaaaagttaccaagaactttctgatgctttggctaagatgtttagctcctttactaatggaaattatgggtcccaaggaatgatagattttatgaatgagagcaaattgatggatctccttaacagttctgaatatgtaccaacctatgaagataaagatggagattggatgcttgttggagatgtacctcgggagatgtttggtgattcatgcaagcgtttacgcataatgaaaggatcagaagctattggacttgcaccaagagctatggagaaatgcaagagcaggatctaaggcaattgatggtgtgcaagctccatagataatgcttgaagttgaaggttttgtgagattaatatattgttgttttcatgtgcttgtatttttaattttaattagtatatagttattaattaaagaagtggtctttaatttggacaatatttgtaatgaacatgatgcaataaacttaaaaccctctattgtgtctggcttgcttattacttaattaaaattaatggtttgattaa

SEQ ID NO: 789 - DNA, 1087 bp, Arabidopsis thaliana
agacagagatataatacagactcatctcactttgtattatttgagtgtttttataaaaccatttttccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacacattgattggtgttaattgctcttttttttcttacgatgaaatacattgttcagtttcttttgattgtctgtgttttgatctggatttggtatgtagatatagtttgtatgctattatgtgtaatgaacttaagttaaatatttgagacatttgtaatggaaaatgtgtaataatttgaacatcctattcctatgtatatgtttgtctttatttatttattttgcc

SEQ ID NO: 790 - DNA, 670 bp, Oryza sativa
cggcatgaacgagagcaagattgctgatctgctcaacggctctgaatatgtgccaacctacgaggacaaggacggcgactggatgttcgtcggcgacgtcccatgggagatgtttgttgaatcatgcaagcgccttaggataatgaaaggatcagaagctattggccttgcaccgagggcaatggagaaatgcaagaacagaagctgagaaagaagaacatgtcgccatcaaaaacggatggatcatcatcagatgcaccaatctatctatagctttttttaattgcagctttgcctcatccctgtatcatactggcttgctgtcttcatctccaagtctgtacctttcctgatcagtgaaagtcattttggtgtggtggtcagtttttgttctgttgcagtcattaagttcctaagtgtgtcattttgtcttatacataagaaagaagccaagaacatgtcccagtagtgcctgtcccataattatgtattttttgctctccctgttcttccctttctctctgttttttttttcccttaatggcacaaaatgtaaagtctccctgttcaaaggggcctcaatgtattttgtccaggaaaaggtcgtttaattatatttcatggtgtatccatcaaacaaaaagttattcatgcaagggtgttatgtgtt

SEQ ID NO: 791 - DNA, 1721 bp, Oryza sativa
  misc_feature (1708)..(1708): n is a, c, g, or t
tgaggaatcggcacgaggatattatcatttcttggccccccaacatcacctctcccttctcctctttatctatggccatgtggcatttccatttcactcctttacatcacatttctagccaccctctcatcatcaccatcaagctcaaaccaacaagaagagagctagcttttggtactattagccactagtagatagccaagaagaaaccaagaaattctttgagctatctaattagctaggtccattgattcatcatcatctccattgatccacttagctttgaagaagaagaagaagaagacatttagttagctagctatattgaggtgaggtggcggcggcaatggcggcggacctggccttcgaggcgaccgagctccggctcggcctgcccggcggcggcggtgatggagacgccgcggcggcggcggcgaggagctcctccgggaagaggggcttcgccgagaccatcgacctcaagctgaagctggagccggcggccgcggcggtggacgacgacgacgacaaggaggaggcggcggctgacgaccgggagaagaaggtcgacatcgtcggagctgacaacgacgacgcctcgccgccggccgccgccgccgccggcgggatgaagcggtcgccgagccagagcagcgtcgtcaccgccgccgccgaccccgagaagccaagggctcccaaggcacaggtggttgggtggccgccggtccggtcataccggaagaacatcctggccgtgcaggccgacaagggcaaggacgccgccgacggcggcggcgacaagtccggcgccggcgccgccgccgccgccttcgtgaaggtgagcatggacggcgcgccatacctgcgcaaggtggacctcaagatgtacaagagctaccttgagctctccaaggcactcgagaagatgttcagctccttcaccattggaaactgtgggtctcatggggtgaacggcatgaacgagagcaagattgctgatctgctcaacggctctgaatatgtgccaacctacgaggacaaggacggcgactggatgctcgtcggcgacgtcccatgggagatgtttgttgaatcatgcaagcgccttaggataatgaaaggatcagaagctattggccttgcaccgagggcaatggagaaatgcaagaacagaagctgagaaagaagaacatgtcgccatcaaaaacggatggatcatcatcagatgcaacaatctatctatagcttttcttaattgcagctttgcctcatccctgtatcatactcgcttgctgtcctcatctccaagtctgtacctttcctgatcagtgaaagtcattttggtgttgtggtcagtttctgttctgttgcagtcattaagttcctaagtgtgtcatcttgtcttatacataagaaagaagccaagaacatgtaccagtagtacctgtcccataattatgtcttttttgctctccctgttcttccctttctctctgttttttttttaccttaatggcacaaaatgtaaaggcaccctgctcaaagggacctcaatgtattttgtccatgaaaaggttgtttaattatcttcatggtgtatccatcaaacaaataattattactgcaaggtgttatgtgttaattaattgtattgtatgaggatggtgtctgctctgctccctgccttcttttaatcaattgattaatnccccattacattg

SEQ ID NO: 792 - DNA, 1706 bp, Medicago truncatula
cggccggggatatcaccaaaaccatcttctaaacgcacaaaaaaactcttcgcaaattctcacatatttctctttcatctttcaccaaaaaaagaaaaagaaaaacattcttctgtgtagcaagaaaagagaaaatgactaacgttggggatgcagagagagacaagtacagcttgataaattttgaggagaccgagttacgactcggtcttccaggtgcaggtgatcacggagaatcacctgttaaaaatagttgtggaaagagaggtttctcagaaactgctaatgttgatttgaagcttaatctttctcctataaatgattctgcttcatcttcttcaactatagcttctgtagctgaaaacaaaggcaaagacacaacaacttctgctactgtttctcctcctcctcgtgctaaggcacaagttgtgggatggccaccagttagatcctttagaaagaacatagtaaatgttcatcaaaagagcaatagtgaaacagaagtagataagagcataagtggtggtggtgggaatggagcatttgttaaggtgagtatggatggtgcaccatatctacgtaaggtggaccttaaattgtacaagagttaccaagagctgtcagatgcgctggctaaaatgtttagttccttcacaattgacaattgtgggtcccaagttaccaaagacttcatgaatgaaagcaaattgattgaccttttgaacggttctgattatgtaccaacatatgaagacaaagatggtgattggatgcttgttggtgatgttccttgggaaatgttcgttcaatcgtgcaagcgtcttcgcataatgaaaggttctgaggcaattgggctagcgccaagggcagtggaaaaatgcaagaacagaagctgaaatccttgttgtgttccgacaaaaatccacttctggttgataaatctgcatcccaaggaagcaagttggctcgagtaaggtcgaggctaatataggaataagagttctcgattatattattattgctatgtgtctgctatttcttttgtatttttttctctcttaatatgtgtattatatatgaatgagaaattaggtggaaattcattagggacaagaaataatatagaagatgtttatatgacccagtttttgttttataaggggaaaaaaaatatgactctgtctattgccagcgtgtgcttgacttataataatgcaaatgtttccagttatcattgctggatttgtccccccattatttgtattttgtacagtatgtgacagagtatgtgcatacatacctaccttatacgtatcatatttattgtgtaatgtatatagttttgtgaatgatatgcaagatcctttgtaatattaggtacacaacatgcacttgtctgtcaagttgtaaatggagctgatttgttgaggtgtgattgcctctagatccgtgaacatggtggacccataccatgtgcttgttgttacggccttcaatggagggatccactactttatttcacatgttccctcttattcttattttgtgattaatatttattgttgatggctcactttctaagatggagtggatggctatcctaaagaattattggtggtgggaatataagatttttttttttttttggtcctgttaacgaatatttttaagcttaaatatgtaaatcgtttctataagtttgcgtg

SEQ ID NO: 793 - DNA, 1279 bp, Arabidopsis thaliana
atttagccctttgtttctctacacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctatttccgttaaaaccaacttttgtttttacgcattatcgtgttgtctatatggtctgtgtccgtaaggcatcttaatgtgttactttgacgtaccaaattattacttacattatttcatttctcaacaatcttttttt

SEQ ID NO: 794 - DNA, 891 bp, Solanum lycopersicum
taaaaaaaataacaaaaaatgagtagtaataagttggattttgaggagacagaattaaggctagggttgcctggtggagcaagaaaaaatgtttatggtgataatgatacttgtaatgttaatggtaaaagaggctttgtagatttgaagcttaatctttcttctgatattaacaacatcaagaattcaacacacaaaaccccagctgccaaggcacaagttgtgggttggccgcccgtaaggtcctttcgaaagaatattttgacttctcaaaagcttgatcgagagaatgataatattttggtgaaggtgagcatggatggtgcaccttaccttaggaaagtggacttaaacatgtacaagagttatcaagaattatttgatgccttaaccaagatgttcaattccttcactattgtccaaggaatgaaagatttcatgcatgaggggaaactgatggaccttttgaatagttctgattatgttcctacctatgaagacaaagatggtgattggatgcttgttggagatgtcccatgggggatgtttgttgattcttgcaaacgcttgcgcatcatgaaaggaactgaagcaataggactagcaccaagggctatggagaagtgcaagaacagaaatggatgaaatcaacgttaacctttttaaatgaatttcatcaatcaaaatttcatcgattatagtaaatgtttattcgaattgaatagtgtgttatgtattaatgctgctattataaagtgcttgtatgtattaataatgagtgtagcatatttatttctgtaaatgtaatttatttagtgctataatatttcttatttaatacaactcgataaatcgtttgtctaataataatttagtttaagttgcttaaaa

SEQ ID NO: 795 - DNA, 1095 bp, Medicago truncatula
atttccacatagcaaacaaattattcacttgaattgttagagagagaaaaagtgttatatataattaagagagtgaaaaactcatcatggaagttgttggtatgaagaaggagaatatgggatttgaggaaactgagttgagacttggaattggatttcttggaaataatggatcagccacagctactgaaggagttgtaaggaagagaggattttctgagactgaaactgatgatgatacaactactatggatttgatgcttaatctttcctctaaggaagctactgctgaggtagatccaagtgatataaccaccaagactttgcaaaaggagaagacccttttgcctgcagatcctgccaagcctcctgcaaaggctcaagtggtgggttggccacctgtccggtcgtaccggaagaacatgttagcaatgcaaaagagtgaaagtgagaagaacagcagttccaatttcaatgcaattacatttgtgaaagttagtatggatggagctccttaccttcgtaaggttgacttgaagatgtacacaagttactcacagctttctgattccttaggcaaaatgttcagctccttcaccattggcaactgtgaatctcaaggaatgaaggatttcatgaatgagagtaagttgatggatcttttaaacaattctgattatgttccaacctatgaagacaaggatggtgactggatgcttgtcggtgacgtcccatgggagatgtttgttgaatcatgcaaacgtttgcgtatcatgaaaggaaaggaggctattgggtatagcaccaagagctatggaaaaatgcaagaacaggagctagacttgctggtcgcacttgttcgccacctgctccatcttttgtcatattttggtacctgcaggatgttcagtatagttaatttgtgtaatgttatatggtttttattttttgataaaattgttatatggtttgttatacatatataatgtttgaaacaaaatacaatgagagtcttaagtgctgattactttaaacagaaacaataaacgactcccaaattatgttgttagatttggctttcttatatattatcta

SEQ ID NO: 796 - DNA, 1157 bp, Medicago truncatula
caacgtgctcttgcctttctttctatataccccttcctctattattgtcacaaaccaatcaaatcacactgaatgcttagagagagaaagaaaaatttagagagagaaaaaacttgataatggaagttgttgcagggatgaaaaaggaggaaaagatggtgtttgatgaaactgaactgaggttaggacttggattgccagggaaaacaacagaagtagtaaggaagagaggtttttctgaaactgagagtgaaagtgaaacaaacactgtggatttgaagcttaatctttctactaaggaaggagcaacagatccacaatttaagccaaaggagaaggctcttctgctctctgattctggtgccaagcctcctgctaaggcacaagtggtagggtggccaccagtgcggtcattccgtaagaacatgtttgctgcccaaaagagcaatgaaggatcagaagaaagtgaaaagaagaatagcaataataatccaataagctttgtgaaagttagcatggatggagcaccttacctccgtaaagtagacctcaagatgtacaagagttacccagagctctctgatgccttggccaaaatgtttaactcctttaccacaggaaattgtgaatcccaaggcattaaggatttcatgaatgagagtaataagttgatggatctattgaacagctccgactatgtcccaacttatgaagacaaagatggcgactggatgcttgtcggtgatgtaccatgggagatgtttattgattcatgcaagcgtctacgtatcatgaaaggaaaggaagccattggactcgcaccaagagccatggaaaaatgcaagaacaggagctagctagactagtctttacagtccataacctgctccatgtgatgcccagttgacttggcaactgaagcaacgttaagctgcagcagaaacatatggactcatgagctagctgttaaaaatatatagatataatttgtgtatgtgtaacattattatatggtttgttatatattattttaaaaaaaattaattaagcattgagatgtccaagtataaattatgaccagaaacgataatgactctaaattatgtgtttctgttgcaaaactctatttatatttacttgttgtgtgcttgcataag

SEQ ID NO: 797 - DNA, 953 bp, Populus trichocarpa
gctaacacacaactgcgtgccaattataagcttagagagagaacagagagagtgggttttagagagagagaaagggagtgatcagtttctgagaggaaactaagagagagcgggcaaaaaagtattctcatcatggaagtggagaagggaacaaagatggggtttgaggagacagagctaaggctagggttgccagggaatggtggaggggctgaaggagagatggtgaggaagagaggattctctgagactgtggacttgaagctcaaactttcttccaaggagagcggtgctgatccaaatcatgagaagaccagcagtttgcaaagggagaagaatcttctggccactgatccagcaaagcctccagctaaggcacaggttgtgggatggcctccagtacgatctttccgaaagaacatgttagcagtccaaaagagcagcactgatcaagagtgtgagaaggttcctggcggcaatgctacctttgtgaaggttagcatggatggggcaccttacctccgtaaagtggacctgaagatgtacaagacctaccaggagctttctgatgccttagggaaaatgttcagttcctttactataggcaattgtggatcccatggattgaaagatttcctcaatgagagcaagctcatagatcttctcaatggcactgattatgttccaacttatgaagacaaggacggtgattggatgctcgtcggtgacgtcccatgggacatgtttgttgaatcatgcaagaggctgcgaataatgaagggaacggaggctactggacttgcaccaagagccatggagaagtgcaagaacagaagctacaagtagtgagagccacagcctgctcctttgatctcgtgggtcgcaggaaccaaaaagatgataaaacgcgtagatggattgagcaggttgttctcgtggagctgtttctgtaa

SEQ ID NO: 798 - DNA, 941 bp, Arabidopsis thaliana
atcaaccagctcaccaagaacaagaacaagaagaagaagaacaagacaagaagaacaaagtacccaagaaaacacacaagaaggaaacacaaagattgatattgatccaaaagcaatggcgtacgagaaagtcaacgagcttaaccttaaggacacagagctatgtcttggattacccggaagaacagagaagatcaaagaagaacaagaggtttcttgcgttaaaagtaacaacaagcgtctatttgaggaaactcgtgatgaagaagaatctacacctcctaccaaaactcaaatcgttggttggccaccagtgagatcttcccgtaagaacaacaacagtgtgagctacgtgaaagtgagtatggacggagctccttaccttcgcaagatcgatctcaagacatacaaaaactaccccgagcttctcaaagcgttagagaatatgttcaaagtcatgattggtgaatattgtgagagagaaggatacaaaggatctggatttgtaccaacatacgaagataaagatggtgactggatgttggttggtgatgttccatgggacatgttctcttcttcttgtaagagactcagaatcatgaagggatccgacgctcctgctctagactcttccttatgatccagagaagctgagaatcttttgtctaaaaaggagatgatgactatgatcgatgaatgaaaaaccctttttggtttgattcggatcggagtttgactaaagttgaccgtgaaagacgaaacttcggggttttgtccgacgagagatccatctctagtgatgttctttttgtttttgtatttagatttgaagtttgatgtaaagatacatgagattttatgtataatacggacacatacacaatctatagatgtataatgtattaagtagttatgtcctataagatcatcagttttctgtt

SEQ ID NO: 799 - DNA, 837 bp, Arabidopsis thaliana
acaacacacacaagcattttcaaggatatcaaatcacaatcccaagaagagcaataacaagagaagaagaagtagttcaagaattaaggaagagagcttctccgttaaagtatagtgagagaatatggaagtcaccaatgggcttaaccttaaggacacagagcttcgtttgggattacccggagcacaagaagaacaacaactagaactttcttgcgtcagaagcaacaacaagcgcaagaacaacgactcaacagaagaatctgctcctcctcctgcaaaaacacaaatcgttggatggcctccagtgagatctaaccgtaagaacaacaacaacaaaaacgtgagttatgtgaaagtgagtatggacggagctccatatctccgtaagatagatctcaagatgtacaaaaactatccagagcttctcaaagcactagagaacatgttcaagttcacagtaggtgaatattccgagagagaaggctacaaaggatctggatttgtacctacttatgaagacaaagatggagattggatgttggtcggtgatgttccatgggacatgttctcttcatcttgtcaaaaactcagaatcatgaaaggatccgaagctcctactgccttatgatccattgtctcaaaacaccttttggtcgaggcaaaaacaaattctactttgtttagataaaaaaaagtttggtgtaaagaaagaaaaagcaatagggttacaaatacgttatatagatgtaaactagctttggttaattctgtaaaagatgagttttgattatacgaagtttatatgtatgctcaagatatttgatactaacataa

SEQ ID NO: 800 - DNA, 1178 bp, Arabidopsis thaliana
gctgttactgctaccgacaagcttagctttttttcctttgtccttaattcagaaaacagtttcttctctctctaccagtatctatctttattctcctttaacttgtataaaacactcagcttcctcgaagcctctcatcttcatcatcagcagcttctctatatctctcctctctttcaaggataataaccaaaagcttttctttttatcttctcctgcaattcttgaagaaatggatgagtttgttaacctcaaggaaacagagctgaggctgggattaccgggaacagataatgtatgtgaagcaaaagagagagtttcttgctgtaataacaacaataagagagtactatcaactgatactgagaaggagattgaatcatcatcaaggaaaactgaaacatcccctcctcgaaaggctcagattgttggatggccaccagttagatcttacaggaagaacaacattcagagtaagaagaatgaatctgagcatgagggtcaaggaatctatgtgaaagtaagtatggatggtgcaccatacttgaggaaaatagatctgagttgttacaaaggatactcagagttgcttaaagctttagaagtgatgttcaaattctctgtgggagagtactttgagagagatggatataaaggttcagactttgtgcctacttatgaagacaaagatggtgattggatgctcattggtgatgttccatgggagatgttcatatgtacgtgcaagagactaaggatcatgaaaggatcagaagccaaaggtttaggctgtggtgtatgagatatatcttcaagaaatctaacagagacacaaaagaacttgaagaaaaatagagtttcttttggttcagagaaatctctgtctgtgcttgggttgtcgggtttctcgggcaagatctatgttcattggattgaatccaattcatagcctttatttacctcatcggtaaaattcaaatgtaaacatgcttaatggtcttaagcatatgaaactggaacctaattacattttgtttcagaaacagggcaaaaggttgtccttaaatctttggttatgtgtattacattaattaaagtgttatgaagattgaagagttgtttttatatttgtagcaattctgttttgcgttctcattgatcaaagagattttcaagca

SEQ ID NO: 801 - DNA, 1090 bp, Solanum lycopersicum
tctatatacagctctcttatttcactttctccttatatattacagcaagctaccatttagcatcttcaaaccaatcttggagaagaaaaatcatcagttttggagaaggaaacttgaattgcaatccaattttgtgaaaaagaaaaatggagtgtgttttggctcatgagaaagatttgaatctcaaggcaacagagcttagattgggtttaccagggaggacagatgaagaatctgacaaagaaattgtatttcatttcaagaataacaagagggctttgcctgaggatgaagattgtgaatcaaactccatttcagatcccaaaactccacctgttgccaagacacaaatagtagggtggccaccagtaagagctaacaggaaaaatagctttccatcaaagaaagcagaagctgaatgtgggatgtatgtgaaagttagtatggatggagccccttatcttagaaaaattgatctgaaattgtacaagggttatccagaactgttgaaggcattagagaaaatgttcaagctgagtatcggtgaatattcagaaagggaagggtataaagggtctgaatttgctcctgcttatgaagataaagatggtgacttgatgcttgttggagatgttccttttgaaatgttcttatcatcatgtaagaggctaaggataatgaaaggatcagaagcaagaggattaggatgtggagtttgagaagaagaataataacaagattatgaattcttctctgttttaaacaggaaaaaaaaaggggtctttttgagcttgggttgtcgaattgcaaagaagctggaaatttgttttacactgattgggaagtgcaaaacagaagaaagagcagtttttgttttgaaggggttgaaaaaaatgaaactcttattcctatatgttgtgcaggcttttagaaaccatggtggtttttatagatcctgcagtgtgttaaatagcatatgaagtatgaagaatgtatttgctctgaaagcaattgtatagacacagtattctcaaatgtaatgagtttttttcctttgtactacttttaatctacgggttttaacacaaag

SEQ ID NO: 802 - DNA, 854 bp, Solanum lycopersicum
gccggggacctttttcttgaaatacacaacttcttctgagatagtaaataaaggagcaatcttgatcaagaaagtgtttaaagaatttctgtgtgtgtgtgttttgagatttgaggatttcatttggtgttttgggtatttcaagattcaatttttaattttttttggaggagagaaagaaaatgacaagtatagtgggcaatcagaaagatctgaatttcaaagccactgagctgagattaggtttgcctggtacagaagatcaagaatctgaccaagaaatatcaaattccaagaataacaacaaaagggctttacctgaatcaactcatgatgaagaagattgtgaatctaagtcaagttctgatcatgtcaaaaccccaccacctgttgccaaggcacaaattgtgggttggccaccagtgagatctaacaggaaaaacatcatccaaccaaagaaaacagaatctgaatctggaatgtatgtcaaagttagcatggatggtgccccttatctaagaaaaattgatctgaaaatgtataaatgttatcaagaactactaaaagccttagaaaacatgttcaaactcaccataggtgaatactcagaaagagaaggctataaaggctctgaatttgcccctgcttatgaagacaaagatggtgatttgatgcttgttggtgatgttccttgggaaatgtttatgtcttcttgtaagaggctgagaataatgaaaggatcagaaacaagaggcttgggatgtggagtttaacttataaattataaaaattcccaaatagaatattatgatgatgaagaagttttttttccctcttttttacagtaaaaagag

SEQ ID NO: 803 - DNA, 1321 bp, Populus trichocarpa
gcctcaaaggtgctgctattgctaccgacaggcttagcttgcctttgtccataattcatgcatttgaagagagaataacaaggcatttctctcaacctcttccttttgtatataaaatacacttgtttccattcacacctgcatcccctcacagaaaaactagctaccatttctctcaagaatcattaccaaaggaaatcacaagagcaacttccaagtcttgtatacatcatctcttagcagttcctgtttttgaacaaagattgttggaaaatatggaaggtggtgttgcatatgagaatgatctaaacctcaaggcaactgagcttagactggggttgccagggacgagctgtactaatgaagaacaagcagtttctggtgctagaaacaacaaacgaccattgccagagaccagagaggagcgtggagcaaaaggcaaatctgatcctcgacatgatgaccaagaaactgcccctgctcccaaggcacagatagtgggctggccaccaatcagatcctaccggaaaaacaccctgcagccaaagaaagctgaagccgaggctgcggctgggatgtacgttaaagtaagcatggatggagcaccataccttagaaagattgatctaaaggtttacaagggataccctgagctcctaaaggctttagagaacatgttcaagctcaccataggtgagtactctgaaagggaaggctacaaaggatcagaatatgcacctacttatgaggacaaagatggtgactggatgctgattggagatgttccatgggatatgttcctgtcatcctgtaagaaattgagaatcattaaaggatcagaagcaacaggttaatttgggttgtggtgtatgaaaaacccacaggccatgttaacccacaggatcagggagaagagaagattcatcccttgagaaaatctttcagcttgggttctccaggaagaaaactcaaatctgaatctgggtctctctcttgactgggttttctacagatggctggaagttttagacaggaaacaggaaaaatcagagtgaagttacggtttctatatatcgtagggtgtggcagcgagatatctggtggtttggacatctatggtgtcattttgttggtccttgtaatctcaccaaaccaaaactggatacaggaagttattattgcttcaaatgcaattatgtaaaatcaaaacagaaaagaaacatatggaaattaagacagggtcgtccatgtttttgccatgtaatgttctccatacaccgctaaagctaaatacaaaagtctgtttgacagttctctaaca

SEQ ID NO: 804 - DNA, 1209 bp, Populus trichocarpa
ccctcgcagagagaatactagctattatttatttctctcaagaatctacatatcaaaaggaaacaacaagagcaatcttcaagtctcctgtgtacatcatctctttacagatcctgcgcgtgaacaaagattgttggaaaacatggaaggtggtgttgcatatgagaatgatctaaacctcaaggaaactgagcttagactgggtttgccagggacgggttgtaccaatgagaaaggagtttctggtgctagaaacaacaaacgaccatttccagagaccagagaggagggtggagcaaatggtaaatctgatgctcaacatgatgaccaagaaactgcctctgctccgaatacttattcatttgatatgcatgcgacatgcagggtacaaatagtgggttggccaccaatccgatcctacaggaaaaatagcttacagccaaagaaggctgaggacgaggctgcagctgggatgtatgttaaagtaagcatggacggagcaccataccttagaaagattgaccttaaggtttacaagggataccctgaactcttaaaggctttggagaacatgttcaagctcaccataggtgagtactctgagagggaaggctacaaagggtcggaatatgcacctacttatgaggacaaagatggtgactggatgctagttggagatgttccttgggatatgttcctgtcttcctgcaagaaactgagaatcatgaaaggatcggaagcaataggcttgggttgtggtgcatgaaaaacccacaagccatgttaacccataggagcagggcgaagagaagattcatcccttgagaaagtctttcagcttgggttctcctagaagaaaactcaaatctgaatccgcgtctctctcttacagagtttttcacaattggactggaagttttagacaggaaacaggaaaaaccagagtgaagttacagtttctatcctagagtgtggcagcgagatatttggtggtttggacacctatggtgtcattttgttggtccttgtaatctcatcaaaaccaaaactgcatacaggaagataatattgctccaagtgcaagcaattatgtaaataaaaacagaaagaaacatatggaaagacagggtcgtccatgttttgccatgtagtgttctcaatacaccactataagctaaatataaaagtgtgtttgccaagttctaacaa

SEQ ID NO: 805 - DNA, 875 bp, Populus trichocarpa
atggcatacgaaagcgatctaaatctaaaggcaacagaactgaggttagggttgcctggaagtgatgagccagagaaaccatcaactactcctagtgttaggagtaataagagagcctcgccagaaatatcagaggagtccaggtccaagggcagttctagtgtgtcctccaatgtcgaaaatggtgaaagagacagtgcccctcctgccaaggcacaagtagtgggatggccaccaatccgatcttataggaaaaattgcttgcaaccaaagaaaaatgatcaagttgatggtgctggcatgtacgtaaaagtgagcgtggatggagctccttatctcaggaagattgatcttaaggtgtacaagagctacccagagctcctcaaagccttggagaatatgttcaagcttaccattggtgaatactcagagaatgaagggtacaacggatctgaatttgctcctacttacgaagataaagatggagactggatgctagttggcgacgttccatgggacatgtttatctcctcctgcaagaggctgagaattatgaaaggatcagaagctagaggattgggctgttgataaaacaaaaaacaaaacttgaaacctgtcaacaaaaggagatatggtgatttaggggaagagtaatttggctttggatatattctccgagagattaggtctcttaggaacagaaacaagttgatcagatcttctttttttggcttcggttctccctccttggttttggtttccaagatctggatatgtatcaattaaactatagagacagaaagatcacacttttttatctgaattatatataaacgagcgagtctccaatattcagtgctagttacagaaaaaaa

SEQ ID NO: 806 - DNA, 600 bp, Populus trichocarpa
atggagaggtcaatggcatacgaaagacatctaaatctaaaggcaacagaactgagattagggttgcctggaagcgatgagccagagaaaccatcaactactcctagtgttaggagtaacaagagagcatcaccagaaatatcagaggagtctaggtccaagggcagctctagtctgtcctccaatgttgaaaatagtgaaggagatgatgctcctcctgccaaggcacaagtagtgggatggccaccaatccgatcttacaggaaaaattgcttgcaaccaaagaaaaacgatcgagttgatggtgctggaatgtacgtcaaagtgagcgtggatggagctccttatctcaggaagattgatcttaaggtgtacaggagctacccagagctcctcaaagcattggaagatatgttcaagcttaccatcggagagtactcggagaaggaaggatacaatggatctgactttgctcctacttacgaagataaagatggagactggatgcttgttggagacgttccatgggatatgtttatctccacctgcaagaggctgagaattatgaagggatcagaagctagaggattgggttgttaa

SEQ ID NO: 807 - DNA, 1141 bp, Medicago truncatula
ggatctcacatctctttaacatctcacaaagattatcaaagtttaagcactacaaggactttctttcttgcttctatacaattgttagagaaattctgaattatttcaaagatggaaaacaaagttgcatatgagaatgatctcaacatgaaggctactgagctaagattaggacttccagggacagaacaaaatgaagaacaaaaagcaaaaatttccaacaaaagaccattgactgaaacttcaaaggatagtggttcaaaaacttctgatgatgcagcacctccttcaaaggctaagatagtggggtggccaccaataagatcttacaggaagaacagtttgcaagaggctgaggcttctgggatttatgtgaaagtgagtttagatggagctccttaccttaggaagattgatttgagggtctatggtggctatgcacaactcctcaaagctttggaaagcatgttcaagttaaccataggtaattattctgaaaaagaaggttataaaggatctgaatatgaacctacatatgaagataaagatggtgattggatgttagttggagatgttccatgggagatgtttgtgacttcttgcaaaagactaagaatcatgaaaggaacagaagctagaggtgtttgagaaacaaacaaaaacaacaaagttagtatgaaaagtgaagtgttttggtgtgaagggaaaaaacaaagaacctttctgcttgtgttatcggaagaactaaacaaatggatttttgaatcactgtagtgtatgctatgctgctatcagcatacatatctatctgaagttgtgctctaaggaagggaaatggaagatacagtgcagtttcttagtttcctcaacattaattaatttctggttactttagcatctaggaagagatgctattctatgctgttaattatttctactgatttttttttctatgtttcaaatgagaaatctcatagagatttgctatcaaatgaaagagatagagaagggtgctaatatgtattatattgttaatccaagttttttcttgtattgatgcaagattaatacagtgtagtataccaaagtgttgtataaatttctttgttattgaatggactaaaaattaagtataaaaaaa

SEQ ID NO: 808 - DNA, 1100 bp, Medicago truncatula
caaccttgcatttcctactttcacacaattgttacacatttcctcttgtaacatctcaaaagaaggagggaaaaaaaaatattgtagcatcaaattcctaaaactttatagtgactatatattttctaattgaattagagggttttgcataagcaagatggaattcaaggcaactgagcttagattgggattaccagggacagatgaaaaggatatgaaaacaatacatggtagtgttgttaagaataacaaaagacaattacctcaaacttctgaagaatctgtttcaatttctaaggtttcaaatgatgaccagcatgtggagagttcttctgctgcccctcctgccaaggcaaagatagtagggtggccaccaattaggtcttacaggaaaaacactttgcaagaggctgaagttggtgggatatatgtgaaagttagcatggatggagctccttaccttagaaagattgacttgaggatctatggaggttatccagaacttctcaaagctctagaaaccatgttcaaattgaccataggtgagtattctgaaagagagggttataagggatctgaatatgcaccaacctatgaagacaaggatggtgactggatgctagttggagatgttccatgggacatgtttgtgacttcctgcaaaagactaagaatcatgaaaggcacagaagctagaggtttgggttgtggtgtatgagaaacaactgaatttttcctatgactatatgcaagaaaaagagttttggtgtttaggaaagtcaatctttcaattgctggagctaatggattttgaatcttgatttggaagggagatggaagatactttctacataaactttgtcaacatgtttttttggttattttagcatcttgaagtgatgctatatgctatattgtttgttatttccactgaacattttcaataacattttcagaaatttgcatcaaagcaactttgtatacttatagagaattagaattagaagagtcatggtttgttttgtatcaatatataaatagaaactttaattacgtagttatttttttgacagggaaaataaatacatagttgctactct

SEQ ID NO: 809 - DNA, 949 bp, Populus trichocarpa
atggaatttgagagagatcttaatcttgatgcaacagagcttaggttaggcctccccggcactgccacaaaacagtcagagaagcaaacacctaactcaaatcttgccaagagcaacaaaagatcattgcctgacatgaatgaagagcccgcaggatcatcaagggaaaattctagcactgtctcatcaaatgacaaaaaaagccatgaccaagaaactgctccacccatcaaggcacaagtggtagggtggccaccaatcagatcttacaggaaaaactgtctacaagcaaagaaactagaggctgaagctgctggactttacgtgaaagttagcatggatggtgctccttatctcagaaagattgatttgaaggtttacaaaggatatccagaactccttaaggccttagaagagatgttcaaatccaaagttggtgagtattcggagagggaagggtataatggatcagaacatgtaccaacgtatgaagacaaagatggagattggatgttggttggagatgttccatgggatatgttcatcaattcatgtaagaggctgagaatcatgaaagagtcagaagctagaggtttgggttgtgctgtgtaaagcctcacacatgcaattcaggaggcccctaacaaaagatgaagaagagatcagaaagagaaagggaagagttgcacttttagcctgggttctccgagaagaaatatcaaatatggatcaattttatcacccagaaagaaaaaaaaaatggatctggatttttcctttgtgggattgcatgtaatagaagattttacaaggatttgttaggatatcacagatctgcatgtatagttggcaaatttgcttcttgaatgcaattgtacaaagagttctacatcagatcacaagtttctccatgtagcaaaggaatagatcatatttaattacttataaa

SEQ ID NO: 810 - DNA, 1107 bp, Populus trichocarpa
tcaagtgcaattacaacaacacaggaaatactgaaggttgaatttgctaccatttcggaagaggaacaagcttcagtttacatccaaagatcgttgaacaaagaaaagagaagaatggaatttgagagagatcttaaccttgaggcgacagagctcagattaggcctaccgggcactgccacagaacagttggagaagcaaacacctaactcaaatgttaccaagagcaacaaaagatcattgcctgacatgaatgaagactctgcaggaagaagggaaagttctagcgtgtcttcaaatgacaaaaaaagccatgaacaggaaactgctccacccaccaagacacaagtggtagggtggccaccaataagatcttacaggaaaaactgtctccaagcaaggaaactagaggctgaagctgctggactatacgtgaaagttagcatggatggtgctccttatcttagaaagattgatttgaaggtctacaaaggatatccagagctcctcgaggtcgtagaagaaatgttcaaattcaaagttggtgagtattctgaaagggaaggctataatggatccgaatatgtaccaacatatgaagataaagatggcgattggatgttggttggagatgttccatgggaaatgttcatcaattcatgcaagaggctaagaatcatgaaagagtcggaggctagaggcctgggttgcgctgtgtaaagcctcatatgcaagtactgttaacacaagatggagatcgaagagatgatctgaaaagaatcaatctccttgattatgaagactagatcgaggtgcactactctgagctagcttggactctccaggaagaagtatcaatcatggacctgttgcatgaagaaagaaaatgcatggatctgtattttttctttatgggataggatgtaatagaagattttaagagggtttgttaactaggagattacagatcttcttgtatagttagcatatctgcttttggaatgcaattgtacagagaaatacatatgatcacaagttttttccatgtaccgatgaaaggtttaattaagttttcatgctataattaagatacattctccatagcaa

SEQ ID NO: 811 - DNA, 790 bp, Medicago truncatula
cggccggggacatcaaccgcatcttattcttccatccatctcatttatctatcaattctcaatttacacattcacaccaacaaatggaaaattctttggggaaccatcaaacagaaatgaatcttaaggctacagaattaaggttgggattaccaggtagtgatgaagtggaaaaacttccatgcaatttttctgttcttagaaacaacaagagatcttctccagaagaagcaagtgatgtagattccattagcaagagcaaattgaatagttctaatggttcttctcataccacaaatgatgaccaagataatgctccaccttcaaaggcacaagtagttggatggccaccaataagatcttataggaagaatagtttgcaacaaaagaagggtgaagaggttgggatgtacttgaaagtgagtatggctggtgcaccttatttaaggaagatagatctcaaagtttacaagagttactcagaacttctcaaggttttggaaaatatgttcaagtgtacaattggtgaatattcagaaagagaaggttacaatggatctgaatttgttccaacttatgaagacaaagatggtgattggatgcttgttggagatgttccttgggaaatgttcatgtcttcttgcaagaggttaagaattatgaaaggatcagaagcaaagggattgggttgtttttgaaccaagaaacaaaggaaataacagtgaagccattcaagagagtttcctctaattgtcctctcaaaatcagaggcatacttagctgattaaaa

SEQ ID NO: 812 - DNA, 736 bp, Solanum lycopersicum
attcaaatcaatcattctttctaaatcatgagaatttacgagaaggatatcaatgatcttgaggcaactgagctaagattaggtttgcctgggataataaacgatgaatcttcaacatcaactagtacttctaaaaatagcagaaaaagaccttcatctagtagtgtaaatgaaaatgaacaacaagactcagctcctgcaccaaaagcacaagttgttggttggccaccagttcgatcatacaggaaaaatcatgtgtctaaattatcagaatctgataataattcctcaggaatgtatttaaaagttagcatggatggagcaccttatttgaggaaaattgatcttcaggtttacaaaagttatcaagagctactcaaggctttacaaagcatgttcaagtgcactattggagtgtattcagaaagagaaggatataatggatctgattatgcaccaacatatgaagacaaggatggtgattggatgcttgttggtgatgtaccatgggagatgtttataagttcttgcaaaaggcttagaattatcaaaggatctgaagctaaaggtctagcatgtctataaaaacatggaaatatatataaacatacatacaaatctgctagggatgaacaagtttcagttttgtaaactatctcgatcttctattagtttcacgggatatatagatctagatctacatgtacaaatagttttatccttctttttttttttt

SEQ ID NO: 813 - DNA, 1337 bp, Arbidopsis thaliana
gatctcatctttaaatttttttgtttcccatttctctcagaaagtgttctgttctttttttcttttgtaatcactaaatgcttcaaaagtttgtccacaattatatttgaaaaaaatgtctgtatctgtagcagcagagcatgattacataggtttgtcagagtttccaaccatggaagcaacaacaatgtctgacaaaaccaaaaccagagacaataacaacggtctcaatttcaaggctaccgagttaagactcggtttacccggttctgagtcgccggagcgagtcgactcaagattcttggctctcaacaagagtagctgtcccgtgtcaggtgccaaaagggtgttctccgacgctattaacgactctaacaaatgggtcttctctcctggatccactactgctactggtgatgtcggctcgggttctggtccccgtacctccgtcgttaaagatggaaagtcgacaactttcactaaaccggctgttccggttaaggagaagaagagctctgctacagctccagcttcaaaagcacaagtggtgggatggccaccaataagatcattcaggaagaactcaatggcttcttctcaatctcagaaacctggtaataactcagagactgaagaagcagaagctaagtctggaccagaacaaccttgcttgtatgtcaaagtgagtatggaaggtgctccttacttgaggaaaatcgatctcaagacttacaaaagctaccttgagctctcttctgctcttgagaagatgttcagttgcttcaccattggtcagtttggttctcatggagggtgtggcagagatgggttaaacgagagtcgcttgactgatctcttgcgtggttctgagtatgttgtaacctatgaagataaagacagtgactggatgctggtcggagatgtcccttgggaaatgtttatatgctcctgcaagaagctgagaatcatgaagagctctgaggctatcggcttagctccaagggtgatggagaagtgcagaagcaggaactaggaaaagcccttttatgtgataatatatgatttgaaaaaatatgtttttaagaaattgaatagccattttgttttgaagtattcttgtgtgtttgtgtgctaggagtgatgtttgatctttcttaaaccagcctctactaagctctaataaggcctcttcctcttacttctttctctaatcaatctaatgaaacatatgggtttgtgtatgtgtgtttgccaaggaagacttcataattcatatgtataaaagttttggtagtgtgtaaaccggatgtggttttcattgttatatatgttttgga

SEQ ID NO: 814 - DNA, 1383 bp, Medicago truncatula
  misc_feature (205)..(205): n is a, c, g, or t
acatcaccttcatactctcgtctcttcattctaagttttctataactatcatcataagtaataataatttaaaccttgtgttcaatatttgatatattttcacctagccattttcatgtctacaccattagaacatgattacataggtttagcaaataatccttcaatggacaaaacatcttcatctctcaacttcaaggaaacntgagctcagactaggctgacctggttgtgaatctcctgatagaaaatcagtttctgctgctggtgctggtggtggagtctctttctttgccaacaaagatttgaagagcattaatgtttgttctcctttgaagaaccttgtagctagtgttggagctaaaagaggtttctctgatgctattgatgagtcttctaagaaatggagtttctctatgaatgatggatctgaaggaggtagtttgttctcgccaagaggagggaatgttggaaaacctcttgctggtttagagactcaaactaatattcaaaagattaatacaaatgcaacaaaaaacatcaaagaggttcttcatcaatctgtacatgaaaagaataaacaggtttctggaacaaatgagcatgctaatgctcctgctgcaaaggcacaggttgtgggatggccaccaattcgatcgtttcgaaagaacacgatggcgtcaaatttgacaaagaacaatgatgaagctgagggaaaaccagaattttgactgtctctatgtaaaagtgagtatggatggtgctccttatctcagaaaggttgatctcaagacctacaacaactatatggaactttcttcagctcttgagaagatgttcacctgctttaccattggtcaatgcaattcgcctggacttcctgggaaagatggactaagtgagagctctttgagggatcttcttcatggatctgagtatgttcttacatatgaagataaagatggagattggatgcttgtaggcgacgttccttgggggatgttcgctgactcgtgtaggagactacggatcatgaaaggctctgatgcaattgggctagctccaagagcaatggaaaaatctaggagccaaaactagtccagaaaaactcgttggaccaaagaggagaattcactgatatgcatatataaaggtttacaaggaagtttgagtttatggttatgccccaaatcaaaaatatatgtaactcagtttctcagtttttgtgaattaatagtctgacaagtttttagttagtagaatttatctggagacatgtccagagaatatatacacatattttgtttgcatatctgttttgtgcacctttgaagtttgtgtctgtataaaagaatggcttgttatgctttcaatatatgattt

SEQ ID NO: 815 - DNA, 1317 bp, Populus trichocarpa
tattttcactacttctgtgaccaactttgatgtcttctattccaaaggaacatgattacataggcttgtcagagactccttcaatggaaaaaatctctgacaagctctcctcttcctcctctaccctctccactgaagagaatatcaacagcaacagcaacagcaacagcaacagcaccaatacttctctcaacttgaaagaaactgagctaaggcttggcttgccagggtatcagtctccagagagaaaactaacactacctgcagctggggtgtctctttttggaaaagatattgacaccaacaacactaatggttatcctcttaggccgctaaagaatttagtgtcaggaactaagagaggtttctcagatgccattgttgggtcttctgggaaatgggttttctctgggagtaatggatctgaagttgatttgggtaaaggagctattttgttttctcccagaggtgataatggtaattcccagaaatcttgtgttgcaggacctgccaagaaagatgatgttgctcaatctccaaagccagttcaagagaaaatcagccaagtggctgctgcaaatgagaacagcagtgctcctgctgcaaaggcacaggtggtaggatggccaccaattcgctcattccggaagaataccatggcctctagtttggtgaagaacaatgaagatgtcgaaggcaaatcaggatatggttgcctgtacgtaaaggttagcatggatggtgctccataccttaggaaggtggaccttaaaacttacagcaactatctggaactctcatctgctcttgaaaaaatgttcagctgcttcaccattggacaatgtggttctcatgggctgcgagggcaagatggtctaactgagagtcgtttgaaggatattcttcatggttctgaatatgttctcacatacgaagacaaggatggtgattggatgcttgttggtgatgtcccttgggatatgtttaccaactcgtgcaggagattgaggatcatgaaaggttctgaagcaattggacttgccccgagggccatggagaaatgcaagaaccggaattagcgaaaagagtgcatgaagtcatgaagcttaagaaggatgttttctagattttaagagagccttatagtgtgttgaggtgagctctttgctcatgaagcttgtgcttggaaattttatttagtgtatgggagaaaaaaaaactttttactagtgagaggatgtcattgaacatgcatcctagcttttcttcttccacttgtactttaatttgtgtaaatgaatggattgcttgtgggta

SEQ ID NO: 816 - DNA, 1334 bp, Populus trichocarpa
gtacatttcttaatattccatccatcactcaaaaggaaaaaagaaaaaagaaaaaaatctatcctttctctatcttttttgcctttcttcttcttgaaaaccagtgcatgcttttgttttgagcgagctttgctttttgatgtctatgcccttagagcatgattacataggcatatcatctgaggtttcttcaatggaaaacacctctggtactgatacaataaacatctctaccactgcttctaaaggtcttaacttgaaagctactgagttaagactcgggttacccgggtccgactcaccagagagaggtaatgagaatcaacaacttggtttttccttaaacaacaacaatagcaaagacaagagctttgtgtctggggctaggaggggtttctctgttgccattcatggtggctctgctaactgggttttctctgggaatgccggatctgacccgaatttttctcttcgaggtgctaattctggaaaagaagggttccctcactcatcgaagcctgttgtgcaggagaacaagagtcaggttgatggtgctaacactaatggccatggggctgctcctgcttctaaggcacaagttgtgggatggccaccaattcgctcatttcgaaagaatacaatggcttctcatctttcaaagaatgatgatggtgcagaagtcaagtcaggatcagggtgtttgtatgtcaaggtcagtatggatggcgccccttatctgaggaaagttgatctgaaaacatttggcagctacatggaactctcttcggcactagaaaagatgtttagctgctttacaataggccagtgtggctctcatgtagttcctggccaagatgggttgagtgagagtcgattaatggatctcctgcatggttcagaatatgttctcacctacgaagacaaagacaatgattggatgcttgttggtgacgtgccttggaagatgttcaccgactcttgtagaaggctgaggattatgaagggttcagaggcaattggccttgccccaagagccatggagaagtgcaaaagtcgtaactagtatgatgtgttctctagatggatcaaatcctctgtgcaaaagataatgcaggttgctatattccatcgttgaaagcctttaacgggtctcagatatcggtcccctgtttcttatttgcgtatgaatatcgtaccaagacttgtataataaatctcttgtaggctagacactatcaggttttataggattgtccgctcacttgtattctgaattctggatgatctagctacaatattctgtataaaatggtctgagtgttacaaaatcacaa

SEQ ID NO: 817 - DNA, 1392 bp, Medicago truncatula
ctcttttgatcttgctgattcttcggggtattgaaagattgaagctttttttcttgtttgaaactttgtattcattgtgatgtctctaccaaggctagggataggtgatgaggaaagtaaaagcaatgttactttgttggaaaaaagtttgcatttgaatggttcaaaaccaaaagagttcaactacatgggattaccatcctctaattgttcatcagtggatagttcagttccaaaaattcaatcttttaaagatgagaccaaaagtaatttgaatcttaaagctactgagcttagattgggacttccaggatcactttctcctgaaagagattcatcagatttttgtttgagaagttcaaagcagtttgatgaaaagcctctttttcctttgcaccctcaaaaagatgatcatctttttgaatcaaagcctgctgttttaggtaacaaaagagggttttctgatgccatgaatgttttttcagaggggaaattgaagcctagctccaaaatgcttgagaatgttgccgggcagaaagtgaaagccgatgaaatagcaacagttaagattggtcttgagagacctaatggtgttggtgaaagcaaaccaggtcttaatggttctgcaaataatggaaatagcactgctcctgctagcaaggcacaggttgttggttggcctccaataagatcatttaggaaaaattcattaacaactgcttcaaagaacactgaagaggttgatggaaaattgggatcaggaggtgcagtgtttgtgaaggttagcatggatggtgctccttatttaagaaaagtagacttgaagaattacactgcatattcagaactatcttcttctcttgagaagatgttcagctgtttcaccataggtcaatgtgaatctcatggaaaccagatgctgaatgaaaccaagctgagggatctgcttcatgggtcagaatatgttattacttatgaggataaagatggtgattggatgcttgtcggtgatgttccctgggagatgtttattgatacatgcaggagactaagaatcatgaagagctctgatgccattggtttagcccccagagcagttgaaaaaagtaaaagcaggaactaagcagtaagcagtatcaataatggtcacacacactctatctatctaactgtctatggtgtgaaaatgtttcagtttttttgtttttattattgtcacaatttatataatccctaagacattttagtgtgaaagattcttatatgtcctgttgtgaaggattagtgtgtgaaactgtgaaatattgcattatatatgtttgtggctttgtgtgttgttgaaaacaaaaaactgtttaacttaatatggaatgtaacttttacagtttctag

SEQ ID NO: 818 - protein, 19 aa, Artificial sequence
  Motif
  misc_feature (14)..(14): Xaa can be any naturally occurring amino acid
WFKHLESELGLEEXDNQQQ

SEQ ID NO: 819 - protein, 8 aa, Artificial sequence
  Motif
  misc_feature (5)..(6): Xaa can be any naturally occurring amino acid
YASSXXNI

SEQ ID NO: 820 - protein, 9 aa, Artificial sequence
  Motif
  VARIANT (3)..(3): / replace = "Ile"
  VARIANT (9)..(9): / replace = "Glu"
SLFEKWLFD

SEQ ID NO: 821 - protein, 14 aa, Artificial sequence
  Motif
  misc_feature (3)..(3): Xaa can be any naturally occurring amino acid
  MISC_FEATURE (7)..(8): Xaa can be any naturally occurring amino acid or no amino acid
  misc_feature (10)..(10): Xaa can be any naturally occurring amino acid
IDXSFWXXMXFWFD

SEQ ID NO: 822 - protein, 9 aa, Artificial sequence
  Motif
  misc_feature (3)..(3): Xaa can be any naturally occurring amino acid
  misc_feature (7)..(8): Xaa can be any naturally occurring amino acid
DEXWRLXXT

SEQ ID NO: 823 - protein, 7 aa, Artificial sequence
  Motif
  VARIANT (6)..(6): / replace = "Thr"
KPRPRSF

SEQ ID NO: 824 - protein, 12 aa, Artificial sequence
  Motif
  misc_feature (3)..(4): Xaa can be any naturally occurring amino acid
  misc_feature (6)..(6): Xaa can be any naturally occurring amino acid
  misc_feature (11)..(11): Xaa can be any naturally occurring amino acid
WVXXDXFELSXL

SEQ ID NO: 825 - protein, 9 aa, Artificial sequence
  Motif
  misc_feature (4)..(4): Xaa can be any naturally occurring amino acid
  misc_feature (7)..(7): Xaa can be any naturally occurring amino acid
GRTXRSXMK

SEQ ID NO: 826 - protein, 7 aa, Artificial sequence
  Motif
PRLDLLD

SEQ ID NO: 827 - protein, 10 aa, Artificial sequence
  Motif
  misc_feature (5)..(5): Xaa can be any naturally occurring amino acid
  misc_feature (8)..(8): Xaa can be any naturally occurring amino acid
IQMEXDPXTH

SEQ ID NO: 828 - protein, 5 aa, Artificial sequence
  Motif
  VARIANT (4)..(4): / replace = "Asp"
LNLEL

SEQ ID NO: 829 - protein, 8 aa, Artificial sequence
  Motif
  misc_feature (2)..(3): Xaa can be any naturally occurring amino acid
  misc_feature (7)..(8): Xaa can be any naturally occurring amino acid
QXXAAAXX

SEQ ID NO: 830 - protein, 10 aa, Artificial sequence
  Motif
  misc_feature (2)..(2): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
KXQLXHXMXQ

SEQ ID NO: 831 - protein, 10 aa, Artificial sequence
  Motif
  misc_feature (3)..(4): Xaa can be any naturally occurring amino acid
  misc_feature (8)..(8): Xaa can be any naturally occurring amino acid
DDXXSDSXWK

SEQ ID NO: 832 - protein, 6 aa, Artificial sequence
  Motif
  VARIANT (1)..(1): / replace = "Phe"
  VARIANT (4)..(4): / replace = "Arg"
LLNKVA

SEQ ID NO: 833 - protein, 18 aa, Artificial sequence
  Motif
  misc_feature (8)..(9): Xaa can be any naturally occurring amino acid
  misc_feature (12)..(12): Xaa can be any naturally occurring amino acid
  misc_feature (15)..(15): Xaa can be any naturally occurring amino acid
AQWESARXXAEXRLXRES

SEQ ID NO: 834 - protein, 8 aa, Artificial sequence
  Motif
  misc_feature (2)..(2): Xaa can be any naturally occurring amino acid
  misc_feature (4)..(4): Xaa can be any naturally occurring amino acid
PXLXFSEW

SEQ ID NO: 835 - protein, 5 aa, Artificial sequence
  Motif
  misc_feature (2)..(2): Xaa can be any naturally occurring amino acid
WXPRL

SEQ ID NO: 836 - protein, 6 aa, Artificial sequence
  Motif
  VARIANT (4)..(4): / replace = "Val"
GLPLYP

SEQ ID NO: 837 - protein, 5 aa, Artificial sequence
  Motif
  misc_feature (2)..(2): Xaa can be any naturally occurring amino acid
FXDFL

SEQ ID NO: 838 - protein, 10 aa, Artificial sequence
  Motif
  misc_feature (8)..(8): Xaa can be any naturally occurring amino acid
TGLYMSPXSP

SEQ ID NO: 839 - protein, 6 aa, Artificial sequence
  Motif
  misc_feature (2)..(2): Xaa can be any naturally occurring amino acid
  misc_feature (5)..(5): Xaa can be any naturally occurring amino acid
GXFMXV

SEQ ID NO: 840 - protein, 13 aa, Artificial sequence
  Motif
  misc_feature (6)..(7): Xaa can be any naturally occurring amino acid
VQEMIXXEVRSYM

SEQ ID NO: 841 - protein, 10 aa, Artificial sequence
  Motif
  misc_feature (2)..(3): Xaa can be any naturally occurring amino acid
  misc_feature (6)..(7): Xaa can be any naturally occurring amino acid
  VARIANT (8)..(8): / replace = "Val"
  VARIANT (10)..(10): / replace = "Asp"
LXXYIXXINN

SEQ ID NO: 842 - protein, 8 aa, Artificial sequence
  Motif
  misc_feature (2)..(2): Xaa can be any naturally occurring amino acid
  misc_feature (4)..(4): Xaa can be any naturally occurring amino acid
PXLXFSEW

SEQ ID NO: 843 - protein, 93 aa, Artificial sequence
  Motif
  misc_feature (2)..(21): Xaa can be any naturally occurring amino acid
  misc_feature (23)..(41): Xaa can be any naturally occurring amino acid
  misc_feature (43)..(54): Xaa can be any naturally occurring amino acid
  misc_feature (56)..(73): Xaa can be any naturally occurring amino acid
  misc_feature (75)..(92): Xaa can be any naturally occurring amino acid
WXXXXXXXXXXXXXXXXXXXXWXXXXXXXXXXXXXXXXXXXWXXXXXXXXXXXXFXXXXXXXXXXXXXXXXXXWXXXXXXXXXXXXXXXXXXW

SEQ ID NO: 844 - protein, 94 aa, Artificial sequence
  Motif
  misc_feature (2)..(20): Xaa can be any naturally occurring amino acid
  misc_feature (22)..(42): Xaa can be any naturally occurring amino acid
  misc_feature (44)..(55): Xaa can be any naturally occurring amino acid
  misc_feature (57)..(74): Xaa can be any naturally occurring amino acid
  misc_feature (76)..(93): Xaa can be any naturally occurring amino acid
WXXXXXXXXXXXXXXXXXXXWXXXXXXXXXXXXXXXXXXXXXWXXXXXXXXXXXXLXXXXXXXXXXXXXXXXXXWXXXXXXXXXXXXXXXXXXW

The invention claimed is:

1. A method for enhancing yield-related traits in a plant relative to a control plant, comprising:

a) introducing and expressing in a plant a nucleic acid encoding an ASPAT (Aspartate Aminotransferase) polypeptide, wherein the nucleic acid is operably linked to a PR (Protochlorophyllide reductase) promoter and comprises a polynucleotide selected from the group consisting of:

(i) a polynucleotide comprising the nucleotide sequence of SEQ ID NO: 5;

(ii) a polynucleotide encoding a polypeptide comprising the amino acid sequence of SEQ ID NO: 6; and (iii) a polynucleotide encoding a polypeptide comprising an amino acid sequence which has at least 95% overall sequence identity to the amino acid sequence of SEQ ID NO: 6;

and b) selecting a plant having enhanced yield-related traits relative to a control plant, wherein said enhanced yield-related traits comprise increased biomass and/or increased seed yield relative to a control plant.

2. The method of claim 1, wherein said enhanced yield-related traits are obtained under non-stress conditions.

3. The method of claim 1, wherein said enhanced yield-related traits are obtained under conditions of drought stress, salt stress or nitrogen deficiency.

4. The method of claim 1, wherein said PR promoter is a PR promoter from rice.

5. A construct comprising:

(i) a nucleic acid encoding an ASPAT polypeptide;

(ii) one or more heterologous control sequences capable of driving expression of the nucleic acid of (i); and optionally (iii) a transcription termination sequence, wherein said nucleic acid comprises a polynucleotide selected from the group consisting of:

(a) a polynucleotide comprising the nucleotide sequence of SEQ ID NO: 5;

(b) a polynucleotide encoding a polypeptide comprising the amino acid sequence of SEQ ID NO: 6; and (c) a polynucleotide encoding a polypeptide comprising an amino acid sequence which has at least 95% overall sequence identity to the amino acid sequence of SEQ ID NO: 6;

and wherein one of said control sequences is a PR promoter which is operably linked to the nucleic acid of (i).

6. The construct of claim 5, wherein said PR promoter is a PR promoter from rice.

7. A method for making a plant having increased biomass and/or increased seed yield relative to a control plant, comprising transforming the construct of claim 5 into a plant and selecting for a plant having increased biomass and/or increased seed yield relative to a control plant.

8. A plant, plant part or plant cell transformed with the construct of claim 5.

9. A method for the production of a transgenic plant having increased biomass and/or increased seed yield relative to a control plant, comprising:

(i) introducing and expressing in a plant a nucleic acid encoding an ASPAT polypeptide;

(ii) cultivating the plant under conditions promoting plant growth and development; and (iii) selecting for a plant having increased biomass and/or increased seed yield relative to a control plant, wherein said nucleic acid is operably linked to a PR promoter and comprises a polynucleotide selected from the group consisting of:

(a) a polynucleotide comprising the nucleotide sequence of SEQ ID NO: 5;

(b) a polynucleotide encoding a polypeptide comprising the amino acid sequence of SEQ ID NO: 6; and (c) a polynucleotide encoding a polypeptide comprising an amino acid sequence which has at least 95% overall sequence identity to the amino acid sequence of SEQ ID NO: 6.

10. A transgenic plant comprising the construct of claim 5 and having increased biomass and/or increased seed yield relative to a control plant, wherein said increased biomass and/or increased seed yield is resulted from increased expression of the nucleic acid encoding an ASPAT polypeptide comprised in said construct or a transgenic plant cell comprising said construct and derived from said transgenic plant.

11. The transgenic plant of claim 10, or a transgenic plant cell derived thereof, wherein said plant is a crop plant, a monocot or a cereal.

12. Harvestable parts of the transgenic plant of claim 10, wherein said harvestable parts comprise a recombinant nucleic acid encoding said ASPAT polypeptide operably linked to a PR promoter, and wherein said harvestable parts are shoot biomass and/or seeds.

13. Products derived from the transgenic plant of claim 10 and/or from harvestable parts of said transgenic plant, wherein said products comprise a recombinant nucleic acid encoding said ASPAT polypeptide operably linked to a PR promoter.

14. The method of claim 1, wherein the plant is a crop plant, a monocot plant or a cereal.

15. The method of claim 1, wherein the plant is rice, maize, wheat, barley, millet, rye, triticale, sorghum, emmer, spelt, *secale*, einkorn, teff, milo, or oats.

16. The plant, plant part or plant cell of claim 8, wherein the plant is a crop plant, a monocot plant or a cereal, or wherein the plant part or plant cell is from a crop plant, a monocot plant or a cereal.

17. The plant, plant part or plant cell of claim 8, wherein the plant is rice, maize, wheat, barley, millet, rye, triticale, sorghum, emmer, spelt, *secale*, einkorn, teff, milo, or oats, or wherein the plant part or plant cell is from a rice, maize, wheat, barley, millet, rye, triticale, sorghum, emmer, spelt, *secale*, einkorn, teff, milo, or oats plant.

18. The method of claim 9, wherein the plant is a crop plant, a monocot plant or a cereal.

19. The method of claim 9, wherein the plant is rice, maize, wheat, barley, millet, rye, triticale, sorghum, emmer, spelt, *secale*, einkorn, teff, milo, or oats.

20. The transgenic plant of claim 10, or a transgenic plant cell derived thereof, wherein said plant is rice, maize, wheat, barley, millet, rye, triticale, sorghum, emmer, spelt, *secale*, einkorn, teff, milo, or oats.

21. A method for increasing biomass and/or seed yield in a plant relative to a control plant, comprising:

a) transforming the construct of claim 5 into a plant, plant cell, or plant part;

b) selecting for a plant having increased biomass and/or seed yield relative to a control plant under non-stress growth conditions.

22. The method of claim 21, wherein said plant has at least 5% increase in biomass and/or seed yield as compared to the control plant.

23. The plant, plant part or plant cell of claim 8, wherein the plant is rice, or wherein the plant part or plant cell is from a rice plant.

24. The plant, plant part or plant cell of claim 8, wherein the plant is maize, or wherein the plant part or plant cell is from a maize plant.

25. The plant, plant part or plant cell of claim 8, wherein the plant is wheat, or wherein the plant part or plant cell is from a wheat plant.

26. The transgenic plant of claim 10, or a transgenic plant cell derived thereof, wherein said plant is rice.

27. The transgenic plant of claim 10, or a transgenic plant cell derived thereof, wherein said plant is maize.

28. The transgenic plant of claim 10, or a transgenic plant cell derived thereof, wherein said plant is wheat.

* * * * *